US012456543B2

(12) United States Patent
Goss et al.

(10) Patent No.: US 12,456,543 B2
(45) Date of Patent: Oct. 28, 2025

(54) ENZYMES

(71) Applicant: UNIVERSITY COURT OF THE UNIVERSITY OF ST ANDREWS, Fife (GB)

(72) Inventors: Rebecca Goss, St Andrews (GB); Danai-Stella Gkotsi, Leeds (GB)

(73) Assignee: UNIVERSITY COURT OF THE UNIVERSITY OF ST ANDREWS, Fife (GB)

( * ) Notice: Subject to any disclaimer, the term of this patent is extended or adjusted under 35 U.S.C. 154(b) by 1025 days.

(21) Appl. No.: 16/978,441

(22) PCT Filed: Mar. 5, 2019

(86) PCT No.: PCT/GB2019/050612

§ 371 (c)(1),
(2) Date: Sep. 4, 2020

(87) PCT Pub. No.: WO2019/171046

PCT Pub. Date: Sep. 12, 2019

(65) Prior Publication Data

US 2021/0335453 A1 Oct. 28, 2021

(30) Foreign Application Priority Data

Mar. 5, 2018 (GB) ..................................... 1803491

(51) Int. Cl.

*G16B 30/10* (2019.01)
*C12N 9/02* (2006.01)
*C12P 1/00* (2006.01)
*G16B 30/20* (2019.01)

(52) U.S. Cl.

CPC ........... *G16B 30/10* (2019.02); *C12N 9/0071* (2013.01); *C12P 1/00* (2013.01); *G16B 30/20* (2019.02); *C12Y 114/19* (2013.01)

(58) Field of Classification Search

CPC ...... G16B 20/10; G16B 30/20; C12N 9/0071; C12N 9/14; C12N 15/52; C12N 15/1089; C12P 1/00; C12Y 114/19; C12Y 308/01001

See application file for complete search history.

(56) References Cited

FOREIGN PATENT DOCUMENTS

CN 102533800 A * 7/2012 ............ C12N 15/10

OTHER PUBLICATIONS

Banerjee et al., Improving enzymes for biomass conversion: A basic research perspective. Bioenerg. Res., 2010, vol. 3: 82-92. (Year: 2010).*
Bornscheuer et al., Improved biocatalysts by directed evolution and rational protein design. Current Opinion Chem. Biol., 2001, vol. 5: 137-143 (Year: 2001).*
Chica et al., Semi-rational approaches to engineering enzyme activity: combining the benefits of directed evolution and rational design. Curr. Opi. Biotechnol., 2005, vol. 16: 378-384. (Year: 2005).*
Devos et al., Practical limits of function prediction. Proteins: Structure, Function, and Genetics. 2000, vol. 41: 98-107. (Year: 2000).*
Sen et al., Developments in directed evolution for enzyme functions. Appl. Biochem. Biotechnol., 2007, vol. 143: 212-223. (Year: 2007).*
Whisstock et al., Prediction of protein function from protein sequence. Q. Rev. Biophysics., 2003, vol. 36 (3): 307-340. (Year: 2003).*
Podzelinska et al., Chloramphenicol Biosynthesis: The Structure of CmlS, a Flavin-Dependent Halogenase Showing a Covalent Flavin-Aspartate Bond. J. Mol. Biol., 2010, vol. 397: 316-331. (Year: 2010).*
Wynands et al., A novel halogenase gene from the pentachloropseudilin producer *Actinoplanes* sp. ATCC 33002 and detection of in vitro halogenase activity. FEMS Microbiol. Lett., 2004, vol. 237: 363-367 (Year: 2004).*
Bayer et al., Genomic mining for novel FADH2-dependent halogenases in marine sponge-associated microbial consortia. Mar Biotechnol. Feb. 2013; 15(1):63-72.
Ferrara et al., Identification of a Halogenase Involved in the Biosynthesis of Ochratoxin A in Aspergillus carbonarius. Abstract. Appl Environ Microbiol. Aug. 30, 2016;82(18):5631-41.
Fullone et al., Insight into the structure-function relationship of the nonheme iron halogenases involved in the biosynthesis of 4-chlorothreonine-Thr3 from *Streptomyces* sp. OH-5093 and SyrB2 from *Pseudomonas syringae* pv. syringae B301DR. FEBS J. Dec. 2012;279(23):4269-82.
Gasteiger et al., ExPASy: The proteomics server for in-depth protein knowledge and analysis. Nucleic Acids Res. Jul. 1, 2003;31(13):3784-8.
Piraee et al., Use of degenerate primers and touchdown PCR to amplify a halogenase gene fragment from Streptomyces venezuelae ISP5230. J Ind Microbiol Biotechnol. Jul. 2002;29(1):1-5.
International Search Report and Written Opinion for Application No. PCT/GB2019/050612, dated Sep. 9, 2019, 18 pages.

(Continued)

*Primary Examiner* — Ganapathirama Raghu
(74) *Attorney, Agent, or Firm* — McCarter & English, LLP; Yu Lu

(57) ABSTRACT

The present disclosure is based on the identification of a novel sequence motif present in halogenase type enzymes. From this, the disclosure provides methods for identifying and or detecting halogenases (halogenating enzymes) and novel halogenases identifiable using such methods. The disclosure also provides a novel cohort of enzymes and novel methods for achieving substrate halogenation.

5 Claims, 22 Drawing Sheets

Specification includes a Sequence Listing.

(56) References Cited

OTHER PUBLICATIONS

Hammerl et al., The complete genome sequence of bacteriophage CP21 reveals modular shuffling in Campylobacter group II phages. J Virol. Aug. 2012;86(16):8896.
Weigele et al., Genomic and structural analysis of Syn9, a cyanophage infecting marine Prochlorococcus and Synechococcus. Environ Microbiol. Jul. 2007;9(7):1675-95.

* cited by examiner

FAD binding site (GxGxxG)

Tunnel Loop (FxxPxxSxG)

Dsg407 Structural Model

Figure 18:
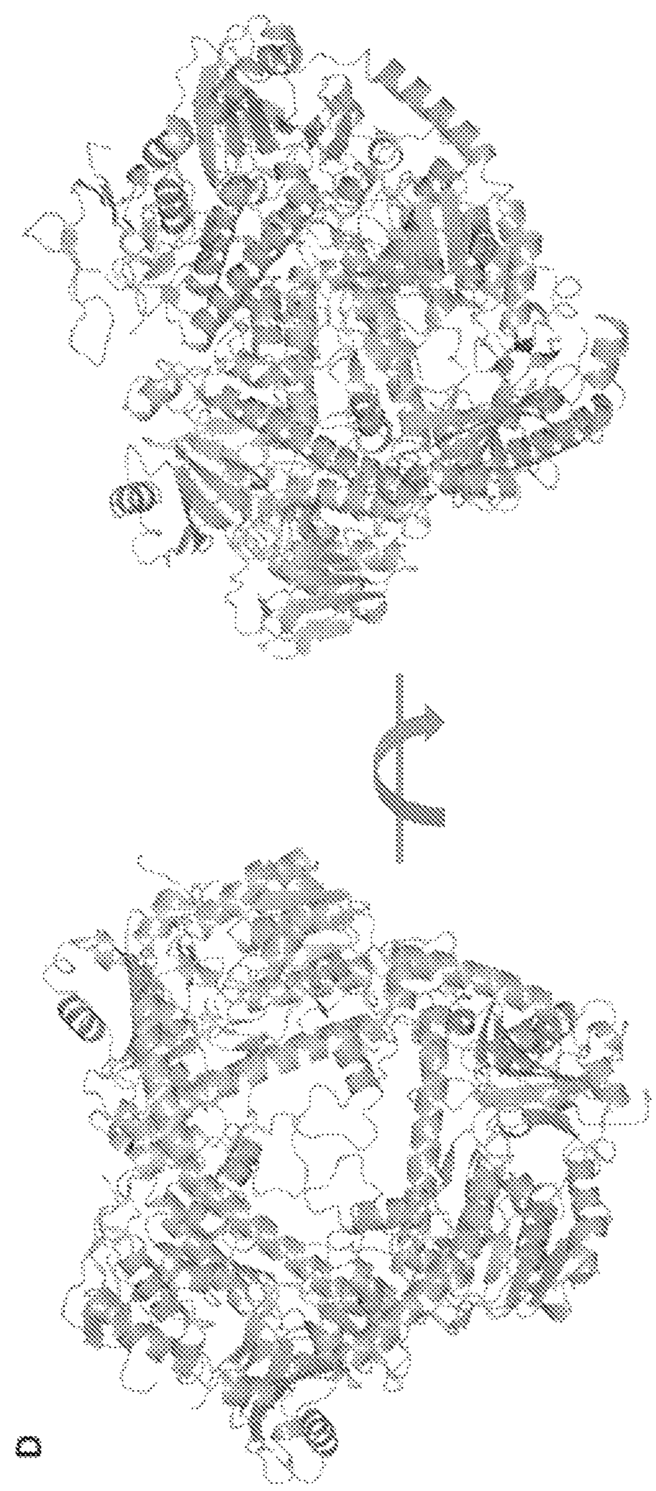

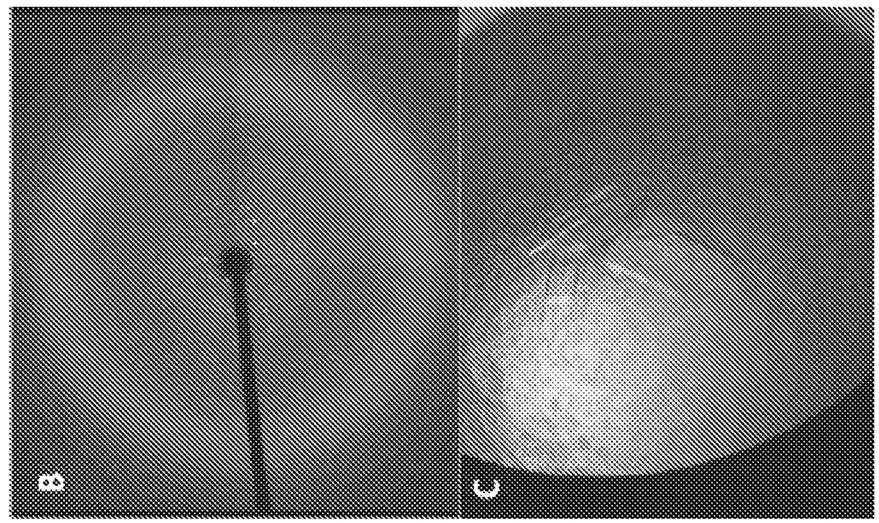
Figure 18B
Figure 18C
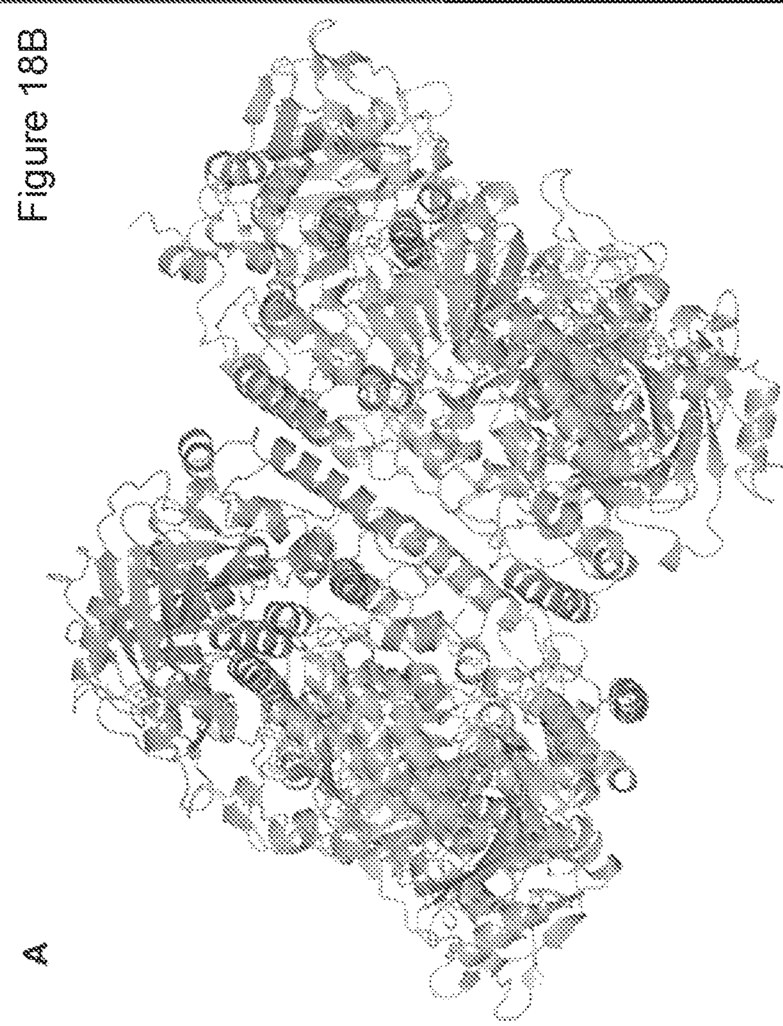
Figure 18 A

ENZYMES

CROSS-REFERENCE TO RELATED APPLICATIONS

This application is U.S. national stage filing, under 35 U.S.C. § 371 (c), of International Application No. PCT/GB2019/050612, filed on Mar. 5, 2019, which claims priority to United Kingdom Patent Application No. 1803491.8, filed on Mar. 5, 2018. The entire contents of each of the aforementioned applications are incorporated herein by reference.

REFERENCE TO SEQUENCE LISTING

This application contains a Sequence Listing in computer readable form, which has been submitted electronically in ASCII format. Said ASCII copy, created on Feb. 6, 2025, is named 123088_03301SL.txt, and is 731,746 bytes in size. The computer readable form of the sequence listing is part of the specification or is otherwise incorporated herein by reference.

FIELD OF THE INVENTION

The present invention provides methods for identifying and or detecting halogenases (halogenating enzymes) and novel halogenases identifiable using such methods. The disclosure also provides a novel cohort of enzymes and novel methods for achieving substrate halogenation.

BACKGROUND TO THE INVENTION

The fine chemical, pharmaceutical and agrochemical industries have an increasing interest in utilizing biocatalysts in process. The need to develop more selective, greener, and more cost effective synthesis drives this shift within the industry, and it is imperative that new enzymes are discovered and developed for process.

The introduction of one (or more) halogens into an organic molecule, is one of the most important and frequently utilised transformations in organic synthesis. Around 20% of the active pharmaceutical ingredients (APIs) and ~30% of agrochemicals are halogenated, including some of the top-revenue agrochemicals such as sitagliptin with annual sales of $3.6 billion and aripiprazole with an annual revenue of $7.9 billion. Similarly, 7 out of the top-10 bestselling drugs over the last decade in the United States contain one or more halogen atoms.

The incorporation of a halogen can have a striking and beneficial impact on a molecule's bioactivity and bioavailability and half-life furthermore the incorporation of a chlorine or bromine into an aromatic system can provide a chemically reactive and orthogonal handle for selective modification through cross coupling chemistry.

Whilst these market sizes for halogenated compounds are significant, halogenation is missing from the industrial biocatalytic portfolio. In contrast to synthetic chemical alternatives, halogenating enzymes afford the highly regiospecific incorporation of a halogen into an organic molecule, obviating the need for functional group protection. The mild reaction conditions (physiological pH and temperature), aqueous solvents and the biodegradable catalyst, provide an attractive alternative to chemical halogenation, which usually utilises harsh conditions, noxious reagents or generates harmful by-products.

Research into electrophilic flavin-dependent halogenases (FDHs) has been limited, almost exclusively, to enzymes identified from halogenated natural products and their associated biosynthetic gene clusters (BGCs). The most well studied FDHs are the bacterial tryptophan halogenases, which chlorinate or brominate the biosynthetic precursor, tryptophan, regiospecifically at the 5, 6 or 7 position of the indole ring. Despite their narrow substrate scope and relatively low activity, work has focused on expanding the substrate scope of these halogenases through the application of protein engineering using either rational design or directed evolution.

The aim of this disclosure is to address the need for new halogenases, which can selectively halogenate a greater range of substrates with tolerance expanded substrate specificity. Using the novel methods described herein, the investigators have determined the first definitive approach for identifying FDHs in silico, their methodologies enable the discovery of FDHs with a broader and more diverse innate substrate specificity than that seen in any other previously investigated wild type FDHs.

SUMMARY OF THE INVENTION

The present disclosure is based on the identification of a novel sequence motif present in halogenase type enzymes. The disclosure provides methods of identifying halogenase type enzymes (that is proteins (enzymes) with halogenation activity/enzymes that carry out, for example, chlorination, bromination and iodination), nucleic acid sequences encoding halogenases, halogenases identified (or identifiable or obtainable) by such methods and a cohort of novel halogenases-including enzymes capable of iodination.

The identified motif may be referred to as a "consensus" motif and may comprise the following consensus sequence:

```
                                        (SEQ ID 1)
            Fx•Px•Sx•G
```

Wherein:

"x" is any amino acid; and each "•" represents independently the number of X residues ("X's") between each conserved (F, P, S and G) residue; thus each "•" can independently represent any number of amino acid residues (for example zero, one, two . . . ten amino acids etc)

In one embodiment, the consensus sequence may be

```
                                    (SEQ ID NO: 2)
            FxxPxxSxG
```

This newly identified consensus motif has been shown to exist in all active flavin-dependent halogenases FDHs including all prior art FDHs and can therefore be regarded as a feature of a halogenase with which to definitively determine its activity. Further, the motif is absent from flavin-dependent enzymes that mediate other reactions such as oxygenations.

Thus the methods described herein exploit the consensus motifs described herein to provide a rapid and reliable method of identifying proteins with halogenase activity.

Accordingly, the disclosure provides a method of detecting and/or identifying diverse halogenases (enzymes (or proteins) with halogenating activity with very different substrate specificity). The methods may be described as being based on sequence and phylogeny data and advantageously allow the identification of new halogenating enzymes which are capable of accepting a wider range of substrates.

The disclosure provides a method of identifying or detecting halogenases (halogenating enzymes or enzymes (proteins) with halogenating activity), said method comprising probing or screening sequences for the presence of a motif or consensus sequence/motif having the sequence:

```
                              (SEQ ID NO: 1)
Fx•Px•Sx•G
or
                              (SEQ ID NO: 2)
FxxPxxSxG
```

or a sequence encoding the same.

The above described method may be used to identify or detect amino acid sequences which potentially encode halogenases, wherein an amino acid sequence which is found to comprising either the motif of SEQ ID NO: 1 or SEQ ID NO: 2 may be an amino acid sequence which encodes a halogenase.

(Note: hereinafter, references to SEQ ID NOS: 1/2 shall be taken to be a reference to either SEQ ID NO: 1 or SEQ ID NO: 2 or to SEQ ID NO(S) 1 and/or 2)

Halogenating enzymes identified and/or detected by a method of this disclosure have been shown to exhibit broad substrate specificity.

Without wishing to be bound by theory, the residues of the motif provided by SEQ ID NO: 1/2 are present in a loop that separates the active site from the isoalloxazine ring of the flavin cofactor binding pocket. This loop is always present in FDHs whether they act on a free or enzyme tethered substrate. Further, the inventors have determined that, in contrast to other motifs, (for example the GxGxxG motif) which may be conserved in all monooxygenases, (and therefore cannot be used alone to determine halogenase function), the presence of the Fx•Px•Sx•G/FxxPxxSxG loop confidently and reliably predicts FDH function.

Again, without wishing to be bound by theory, it is suggested that the Fx•Px•Sx•G/FxxPxxSxG loop plays a role in substrate specificity and active site configuration; this may explain why the motif has been retained and protected from spontaneous mutations.

Methods of detecting or identifying halogenase enzymes based on the Fx•Px•Sx•G/FxxPxxSxG motif, represent an advantage over prior art methods as this motif is absent from flavin-dependent enzymes that mediate other reactions such as oxygenations. Thus, the identification of this motif has, for the first time, enabled the definitive identification of halogenase type enzymes in silico. Further, using the motif of SEQ ID NO: 1/2 in combination with mechanistic and structural knowledge, it is possible to predict halogenase function even at low sequence similarity.

A sequence subjected to the method described herein and screened or probed for the presence of the motif provided by SEQ ID NO: 1/2 may be any suitable sequence including suitable nucleic acid and/or amino acid sequences. A suitable sequence may include, for example a deposited sequence (i.e. a sequence deposited within some form of database, for example a publically accessible sequence data base), and uncurated deposited sequence, hypothetical protein sequences, unannotated sequences, genomic sequences and the like. The suitable sequence might also be sequences within these uncurated databases that have been partially annotated as "putative halogenase" or misannotated with some other functionality, e.g. monooxygenase. Sequences that may be subject to the methods described herein may be prokaryotic or eukaryotic in origin; they may be derived from microorganisms (for example bacterial and/or viral sequences), fungi, plants and/or animals.

The methods described herein enable the user to identify halogenases, in silico, from, for example, the deposited genome sequences of a diverse series of organisms; this is an attractive alternative, the exploration of genes from phylogenetically distinct organisms enables the discovery of halogenases with very different substrate scope, and in all cases has revealed broader innate substrate scope than previously identified wild type halogenases, and on a par with the breadth of substrate specificity observed for engineered halogenases; whilst in other cases the substrate specificity exceeds that of even the best engineered halogenases in which known halogenases are redesigned or evolved.

The process of screening and/or probing a sequence may be referred to as "mining". Thus, a sequence may be mined for the presence of the sequence motif(s) identified and disclosed herein. A sequence which contains, for example, the motif provided by SEQ ID NO: 1a/b (or a nucleic acid sequence encoding the same), may be identified as a sequence encoding or providing a flavin dependent halogenase enzyme.

It should be noted that where the sequence is a nucleic acid sequence, the use of a method described herein may identify and/or detect a nucleotide sequence encoding the motif of SEQ ID NO: 1/2. Upon detection of a nucleotide sequence encoding the motif of SEQ ID NO: 1/2, the nucleic acid sequence may be identified as a sequence which may encode a halogenating enzyme.

Table 1 below, provides an indication of those nucleotide codons which encode the F, P, S and G residues of the motif provided by SEQ ID NO: 1/2. Identification of a nucleotide sequence, containing these codons (in an arrangement encoding the motif of SEQ ID NO: 1) identifies that nucleic acid sequence as potentially encoding a halogenating enzyme.

TABLE 1

| MOTIF | F | x. | P | x. | S | x. | G |
|---|---|---|---|---|---|---|---|
| CODONS | TTT<br>TTC | | CCT<br>CCC<br>CCA<br>CCG | | TCT<br>TCC<br>TCA<br>TCG<br>AGT<br>AGC | | GGT<br>GGC<br>GGA<br>GGG |

The methods described herein may be combined with a probe or screen for one or more other motifs at either the nucleic acid or amino acid/peptide level. For example, the one or more other motifs may be characteristic (or at least partially characteristic) of a halogenating enzyme.

The described methods may further probe or screen sequences for a motif having the sequence:

```
                              (SEQ ID NO: 3)
GxGxxG;
and/or
                              (SEQ ID NO: 4)
WxWxIP.
```

or a (nucleic acid) sequence encoding the same.

Accordingly, a method of identifying and/or detecting halogenating enzymes may comprise a method comprising probing or screening sequences for the presence of motifs having the sequences:

```
                                        (SEQ ID 1)
Fx•Px•Sx•G
or
                                    (SEQ ID NO: 2)
FxxPxxSxG;
```

and optionally:

```
                                    (SEQ ID NO: 3)
GxGxxG;
and/or
                                    (SEQ ID NO: 4)
WxWxIP.
```

It should be noted, that in any given halogenase (FDH) sequence, the GxGxxG consensus motif may be expected to be present near the N-terminus, for example within the first 30 amino acids. The FxxPxxSxG/Fx•Px•Sx•G consensus motif may be expected to be identified near the C-terminus, for example somewhere within the last 80 amino acids.

As stated, the methods of this invention may also be applied to nucleic acid sequences (for example genomic nucleic acid sequences and the like) in which case, the nucleic acid sequences may be probed and/or screened for nucleic acid sequences which encode the motif of SEQ ID NO: 1/2 and optionally one or both of the motif(s) provided by SEQ ID NO: 3 and 4.

Without wishing to be bound by theory, the GxGxxG motif (SEQ ID NO: 3) is located within the first 20-30 amino acids of the N-terminus. This is part of the Rossmann fold. The Rossmann fold, encoded by the GxGxxG sequence motif, is a structural motif which is found it proteins that bind dinucleotides such as FAD, NAD+ and NADP function (reported by van Berkel W J et al., *J Biotechnol,* 2006) (Dym O, Eisenberg D, Protein Sci, 2001). All structurally characterised flavin-dependent halogenases contain this motif both at the sequence as well as the structural level. While this motif is used for FDH identification, it is shared between flavoproteins and as a consequence, users should obtain further evidence to definitively predict FDH.

Further, (and again without wishing to be bound by theory) the WxWxIP motif has also been described as a signature motif of FDHs. It was been suggested by Dong et al. that the two tryptophans, although not directly interacting with flavin, are located near the flavin binding module and may have evolved as a steric block, keeping the substrate distant from the flavin and thereby preventing the enzyme from catalysing a monooxygenase reaction (Dong et al, *Science,* 2005). However, whether this motif can be used to definitively to identify FDHs is debatable, as when W272Phe and W274Phe exchanges were made on the tryptophan halogenase PrnA, no change in halogenating activity is observed (Flecks et al., *Angew Chem Int Ed Engl,* 2008). It has also been noted from the same study that the more extreme W272Ala mutation also made little impact on the enzyme's activity. The inventors have provided additional evidence from multiple sequence alignment of ancestors of FDHs, which shows that variations of this motif can be identified in a wide range of diverse enzymes without halogenase activity (FIG. 3A and 3B); this indicates that the presence of this motif can only cautiously be utilised to imply possible halogenase activity. Furthermore, it is noted that some active WT halogenases (for example the phenol brominase Bmp5 from Pseudoateromonas spp 133) possesses a motif with the following consensus: WxYx(IP) (Agarwal, et al., *Nat Chem Biol,* 2015). This would support the hypothesis of the inventors that this sequence motif might perhaps be structurally important for tryptophan halogenases and to help maintain the β-sheet secondary structure, rather than being critical to catalytic function of FDHs in general and that it cannot be relied upon for definitive functional (FDH) prediction.

Accordingly, the methods of this invention, which methods exploit a motif having the consensus sequence provided as SEQ ID NO: 1/2 are more reliable and better able to definitively identify functional halogenating enzymes (halogenases) As only this identified motif is present in all sequenced and biocatalytically confirmed FDHs. The methods of this invention are more reliable than on those prior art methods which are based only on, for example, motifs having the consensus sequences identified as SEQ ID NOS: 4 and 4.

Table 2 below, provides an indication of those nucleotide codons which encode the G residues of the motif provided by SEQ ID NO: 3. Identification of a nucleotide sequence, containing these codons (in an arrangement encoding the motif of SEQ ID NO: 3 and in combination with a sequence encoding the motif of SEQ ID NO: 1/2 (and optionally a sequence encoding the motif of SEQ ID NO: 4)) identifies that nucleic acid sequence as potentially encoding a flavin-dependent halogenase enzyme.

TABLE 2

| MOTIF | G | x | G | x | X | G |
|---|---|---|---|---|---|---|
| CODONS | GGT<br>GGC<br>GGA<br>GGG | | GGT<br>GGC<br>GGA<br>GGG | | | GGT<br>GGC<br>GGA<br>GGG |

Table 3 below, provides an indication of those nucleotide codons which encode the W, I and P residues of the motif provided by SEQ ID NO: 4. Identification of a nucleotide sequence, containing these codons (in an arrangement encoding the motif of SEQ ID NO: 4 and in combination with a sequence encoding the motif of SEQ ID NO: 1/2 (and optionally a sequence encoding the motif of SEQ ID NO 3)) identifies that nucleic acid sequence as potentially encoding a halogenating enzyme.

TABLE 3

| MOTIF | W | x | W | x | I | P |
|---|---|---|---|---|---|---|
| CODONS | TGG | | TGG | | ATT<br>ATC<br>ATA | CCT<br>CCC<br>CCA<br>CCG |

The methods described herein may be in silico methods.

The methods described herein may be combined (run in parallel, together or concurrently with) one or more prior art methods for identifying halogenating enzymes.

A sequence identified as potentially providing (or encoding) a halogenating enzyme may be synthesised, expressed and subject to an assay which determines activity (i.e. the level of halogenating activity).

An amino acid sequence identified as potentially providing a halogenating enzyme may be used as a template from which to generate a nucleic acid sequence for expression. The nucleic acid sequence may be subject to a codon optimisation procedure to ensure that it is optimised for expressing in or within the chosen expression system.

As stated, a method according to this invention may further comprise a step in which a sequence predicted to provide a halogenase enzyme (or to encode the same) is subjected to an assay to determine the level (or presence) of halogenase activity. One of skill will be aware of those assays and methods that can be used to test for halogenase activity-all of those assays and methods are to be construed as useful in a method of this disclosure. By way of non-limiting disclosure one such halogenase assay might be to monitor by (Liquid chromatography-mass spectrometry) LC-MS the conversion of substrate to its halogetated analogue. Alternatively rather than monitor halogenase activity using LC-MS, other technologies such as spectroscopic monitoring of consumption/production of substrate/co-factor/product.

By way of non-limiting disclosure, one such exemplar potential route to accessing and assaying the FDHs is described below:

Once the candidate halogenase gene has been codon optimised and cloned into the desired expression vectors, the gene can be overexpressed resulting in the overproduced enzyme containing affinity tags such as a histidine tag, which can be used for IMAC purification. Such tags can be then cleaved using a TEV protease. (It is conceivable that a cell free synthesis system, or any other suitable route, could also be utilised as an alternative to this cloning and heterologous expression route.) The pure enzyme can then be used against a library of selected compounds (10 mg/ml stock solutions in DMSO) using appropriate controls. Assays can be set in V-shaped 96 well plates. More specifically, the assays should include 10 μM of the purified halogenase enzyme, 1 μl of substrate (10 mg/ml), 10 mM halogen salt such as NaCl or NaBr or NaI, 1 μM PrnF (flavin reductase), 5 mM NADH and HEPES buffer pH=7.2 and 1 μM FAD. Reactions should be placed on ice and NADH should be added last. The plates can be sealed with gas permeable seals and the reactions should be incubated at 30° C. for 90 minutes. Equal volumes of methanol added to quench the reactions and plates can be centrifuged for 1 h. Halogenated products can be detected by both UPLC and LCMS.

Using the disclosed in silico methods, the investigators have predicted the function of 145 novel flavin dependent halogenases. In particular, the investigators have identified the 145 halogenases identified below (numbered 1-145). Each sequence is annotated with an internal designation (the "Dsg" number), an indication of the species from which the sequence was obtained and a note of the accession number (GenBank or otherwise) for the sequence.

1) Dsg205 from *Trichoderma virens* Gy29-8 GenBank: EHK23009.1
MAIPEKCTVLVVGGGPAGSYAAAALAREGIDTVILEADKFPRYHIGESMLASMRHFLRFIDVDSVFDSYG

FTKKVGAAFKLNPKKREGYTDFLAAGGPENYAWNVVRSEADQLLFQHAAKSGAKAFDGVQVKSINFIDVP

YKGPGQLPHDYPGRPVSATYVQKDDNTPREIKFDYIIDASGRVGILSTKHLKNRKYNQGLKNVATWGYWK

GAGAYGKGTPRENSPFFEALQDESGWAWLIPLHNGTASVGIVMNQKMSVERKTQAGSPDSKTFYLDCLKE

LAPDLTKLMENGELITDIKSAADYSYSASGYAIPYARIAGDAGCFIDPYFSSGVHLAFVGGLSAAATIAA

AIRGDCSEEAAADWHSKKIADAYIRFLLVVLSAYRQIRSQEEPVLSDINEDNFDRAFAFFRPVIQGIADV

DTKLSQDELRKTLEFCSNAFEPVKPEDRTAMLEKLGKDPATAYQVDLSDQQRTVVDHIRARQMMRTEDTI

NINSFGTDSINGFVPNLKRGELGLVPAKV

2) Dsg701 from *Pleurotus ostreatus* PC15 GenBank: KDQ27639.1
MASSTQPYTQPPKHVNVLIIGGGPAGTYAASALAREGIEVAVFEASKFPRYHIGESLIPSVRHYLRFIGA

EEKLANHGFCRKPGSAIKFNQNKQEGYTDFVALGHNNNAWNVVRSEFDQMLMNHARSSGAAVYERTKVNS

IEFSKSNPGRPTSVSWTHTPPPVPLSPPTSPQTKFKKLESNGDASEETSQVVEGVTTFDYMIDATGRAGI

MSTKYLQNRRFNESLKNVAVWGYWENVGTYGVGTKREGAPWFEALTDETGWAWFIPLHNGTTSVGIVMNQ

KSHTDRTKQQVATGDGSSTMTSRYLENILLAPGLVDLIGEGKMVDGTVKSASDFSYSAPKYAGERYRIVG

DAGAFIDPFFSSGIHLAMTSALAASASICASIRKDCTELEATEWHTKRVATSYTRFQVVVLSAYKQMRAQ

NFDVLSEIDEDNYDRAFAYLRPVIQGASEMGARLSEDELQRSLDFCLQLFNPTSPEQHERVFKQGGALAR

QLMDLSQPVMDTSLLLQQIKPLCGRRESPDTSEDSDSDVELVVKKINARRVVHPEYAINNLETEPLEGFA

VRLERGNLGLIGKH

3) Dsg407 from Cyanophage Syn10 GenBank: AGH56623.1
MKIESVAIVGGGSSGWMTAAALSKLCPQLEIALIEDPNIKTVGVGESTLGHFNKFLHLLDLKDEDWMPAC

NATYKNSIRFTNFREGKGEVFEYPFGPSLDVSFFSQTDGINTWGKLANKYPEDFPPETFARFVNSNTYLA

EHNRLTRNKDNKIPNFNFDWDTAYHIDAELFGQYLKEKIALPNGVKHIQGKVTGYQKESPNNHNFKYIIL

DQETAIFADLYIDCTGFKSLLLGEFMGEAFSPFSKKLANDKAMATRIPYENREEEMHNVTDCHAMKNGWV

WNIPLWNRIGTGYCYSSRFVSKDDAEAEFREHLGERGKDAKIFHIDIGHGKRTRAWVNNCVGIGLSYGFI

-continued

EPLESTGLLTTHENIENLVYLINQRDGYVTQAERDGFNYTCDHQIDSFSDFVAMHYAYSMRTDTPYWKWC

TQMCNYMPESMGPHRQKQSTWQDLSTDTIGLNTWHINHNGISFIIAGHGLRPQSYDKLSEVLLKRNNESD

YYYEDIRKDWLKHYESMVEYVKTLPTHYEFLRDEIYGSAE

4) Dsg5 from *campylobacter* phage CP21 YP_007005238.1
MKVTVIGKGTAGILTTKSLRFNFPDLEIDWIYPESNKFIGVGEALVPASSKFLKTIGVDNKMILKDFRGS

IKAGLKMIGWADKTFNLPFDNSVLLNRYMNKDLFPENFINFENVSHHFNTFSLQNLYVENINNINKTVTS

FKDIDSDLIVDCRGFQDSDDFIEPGILKNNIALTTRIPVQNFLNPYSSFFARDFGWCWTIPLQDYISIGY

VTNDSFINQASEDLKKHLQENFKTDLKDYNTIKFKTGYKKQQIAKIEGHNVFSVGLNAAFVEPLQSTGLW

LASQQIQELINYIKNGDTNWNQRFEDMYNRVYQFILNHFILCKKSNEYWDYYKNFNFKDSLFTGSNGNNV

FDGEFENFLYDSFQGKSVKYNIDKNIVGGKAALTKLKKFDELLRDYLSK

5) Dsg6 from *Oidiodendron maius* Zn GenBank: KIM93269.1
MSVPDTCTVLVVGGGPAGSFAAAALARDGIDVVLVDADKFPRYHIGESMLPSIRHFLKFIDCDDKWINHG

FIKKKGAAFKLNWTQPDAYTDFIAAAGPNGYAWNVIRSESDEILFKHAGECGAHIFDATKIESINFVEDA

ETKEAWDSDLPNPGRPVSAIWARKDGSTGLIAFKYLIDASGRQGISSTKYLKNRKFNQSLKNIANWGYWT

GAGVYGVGTHKEGSPYFEALKDASGWCWFIPLHDGTVSVGIVQNQEQATAKKRAQGSPSSKDFYLNSLDL

VPGVKALCGQGTLVSDIKSASDWSYTASSYAFPYARIIGDAGCFIDPFFSSGVHLAILGGLSAAVTIAGS

MRGDCDEKTAALWHSKKITESYTRFFLVVSSALKQIRSQEEPVINDIDEEGFQRAFDLFKPVIQGTVDAD

SNGRFTQADISKAMEFCFKAFTHVTPEEKDALVEKLKSYGLDARADDESTQKAIDEIEKNLTAEELQVLN

ILRSRRMVREDGYNIDSFTLDAVDGLSPNMVRGKLGLKKAESVKLNISNLYSIDYLEGKTPGVRVPNSQD

SSKESMNGHGLNEHSNGIENSMKEGITGSVNGSMRNGTPATREELEGMVKLITPLNNFGSAMDDLHRHAL

MSALYQAAESLETPFDTLMRFSNSRYQLSLIKVGYQLGVFEALVASSAALTAEELAKHTGADPKLVSRVV

RYLAANRIIVELGENLYEANKITKYMADPHMEGGMKYFHTVSSPTVHKLPEFLQENNFQNPIGEPSVWHK

SKNTAMNLFAWLKANQPETLKHLHNLRAFPKERNWLSCIPFAQFSETDRIAFVGMGRNVEHECLRLKEAH

PKLAGRIVLQHLPETPQHAPMIKDVTFISHDIFTPQPVKGAQYYYLRRTLHHWSDEQVVEILRNLVPAMA

LDSQVLIDEIVLPNTAASAPPAAHDLEMMIMFGAMERTINQWNVLLDHAGLKAVEVKTYEIAMQSSIIFA

QLK

6) Dsg8 from *Candidatus pelagibacter* sp. TMED197 GenBank: OUW58431.1
MSVNKITVLGGGTAGLVSALVLKARFEKLNIEVVKSDNIGIIGVGEGSTEHWKDFMEFIGVPLKELLLET

DATFKYGIMFEDWTKEPYFHNITNELHKVALGQYYAGYAYATINKLKPDEYTSGHCFNNEVLPNYIPSQF

HFNTHKLNTFLLKKCKDFGIEVHTDDITDVETDNHGIKRIRGDKGWYESDFYIDCTGFKKYLISKLGAKW

VSYKDYLPMNEAIAFPTPDTDEYTPYTLAKAMSSGWMWRIPTYGRWGNGYVFDNRYINAEQAQKECEDYL

GFKVNVAKNIKFDAGALDRPWIGNCVAMGLCASFIEPLEASSIGTSIQQSFLLMHTLINYKQTDIDQYNT

KVGHIVENIRDFVLLHYIVKRNDSKFWKELKVNLPDSLKHNLDKWSDRMPIKEDFKTDYVLFNAQNFAVL

LKELELANIDSLKREYDMLVEHNKNVVKKEVDHHIKTFKTDPMNKQCPIMGHKQYLMKLRSGKETLNQQI

DYLQNENSNT

7) Dsg9 from *Eukaryarchaeota archaeon* TMED97 GenBank: OUV27629.1
MKIKNVCIVGGGTTGWMMAVALNVNVPNLKVTLVESEEIPSIGVGEATIPLTAKFISSVLKFDEKEWMAA

SDATYKTAIRFNNFSKIDESFWHPFWSDDEIHYNTYDWLIKRQIEDLPTEDFYKSNFIAWYMSMDKRFQE

IKGFQHAHHMDANKFARYCQTQFKGTHINATVSSVEEKDGYIKSITVDGKKIKSDLFIDCTGFNALLIGE

TLNEPYTSYEDTLLNDSALVCRIPYGNDPFTNRQQECHPFTDCTALSSGWVFNTPVWSRTGTGYVYSSKF

QSREDAEQEFRIYLVDRFGGDRGDIAEFRHISFKTGKYERSWVNNCLALTLASGFIEPLESTGLALACWQ

-continued

IENFIDVLKDDDMSSFIRATYNDKVNMAYDEIHTFIAMHYANTKREDTEYWKHIKNNLHITQKMVDYAKN

DNVPDIWFPKKSRECVLIGLDIPSEYSKQHITWHGENFESIMKSDDNEKEFMTAGVQYLNGRKNMYQSIS

NDMPWHEDYLKEHIHVESEDS

8) Dsg10 from *verrucomicrobia* bacterium TMED56 GenBank: OUU35589.1
MSSKNKKLIVLGGGTAGWLTALFLNKIFPKYETTLIESKQVGIIGVGEATTPNIIYMLDYLNINLSELIS

ETKGSIKNGINFENWNGDGKKYFHGFYERLADFSVPPIFKGDCWNHYLNNLISKKLDFNTHTYITKLSYE

NKVDVHKTSYALHFDTNLLSEYLHKTGVDRGIKYVNGKLKKVHSSNLNDNINKITLTNNKSYSCDFIFDC

SGFSRLLIGKHFGVKWKSYKQHLPMKKAIPFWLKQTGNIQPYTTALAMKYGWIWKIPLQHRIGSGYIFDS

NYINDDQALKEAEKTLNTKLEVNKIIDFEAGRYESFWHENCIALGLASSFIEPLESTSIFLTIQQLFNLN

HFLGDMFKENKNSKALYNEMSNKNMDETLNFVYLHYLTKRNDSPFWKNFRKDYPPPTNFRHVLSLIRSGN

LRFLDIEEVKKTAAFPISSYLMVAYGLGLFNKKPNMIYYKNIVPTISQYLDAIKQATDQATPLNIFLDHV

NYK

9) Dsg11 *Sclerotinia borealis* F-4128 GenBank: ESZ98968.1
MSVPTQTSVLVVGGGPAGSYAASLLGREGVDVVLLEADKFPRYHVGESMLASMRFFLRFIDLEKTFDDHG

FEKKFGATFKITTKKEAYTDFAASLGKGGHSWNVVRSESDELLFKHAGKSGAKTFDQTKVDSLQFEPYSR

DRFTAEDHLANPGRPVSAAWSRKDGTSGTINFDYLIDGSGRNGIISTKYLKNRRFNEGLKNIAIWSYWKG

AERYKQGEDNENSPFFEALTDGSGWVWAIPLHNGTLSVGIAARQDFFFERKKTSKLEGKAFYTEYLDLAP

GIQQLLKNAEIVSELKQASDWSYSASAYAGPHFRIIGDAGCFVDPYFSSGVHLALTSGLSAAISVQAARR

GQADEWSAAKWHTTKVSEGYTRFLLLVMTVLRQLRMKEAHLITTEQEEGFDMAFKKIQPVIQGVADTETD

DARVQKNAAEAVDFSLDSFEVTPEKQRAVIDKIEKAQTAPETLEKLTPEEVHILGGIVTRTFEREKDELN

LTSFTGDVIEGLSANLVRGDLGLIRKGKKTVTPETTATMEMLAVESIKSVA

10) Dsg12 from *eukyarchaeota archaeon* TMED248 GenBank: OUX17232.1
MKVEEPDHFIEFENFDPYKGKIESVVIVGGGSSGWMTAAALAKLCPHLEVALVESKDIKTIGVGESTLGH

FNQYLELLDLKDEDWMPHADATYKNGIQFTNFREGKEEVFQYPFYTDYDLTYAPQGINTWAHLANMFPKD

FPPESFAEFYCANTFLCNENKQTRNFDNVVRQFDFRRHTAYHLDATKFGIYLRDHICLPNGVQHILGEIT

GFQTMYEKPNDQTISYLVMDGINAIQADLFIDCTGFKSKLLGGFQGIPFIPAENKLANDKAWAVRIPYEE

ETREKEMRNVTDCWAMKNGWTWDIPLWNRIGKGYVYSSRFCRKESAKQEFIKHLRHTVGKKRADAAELFH

IDIEHGRRQRAWVNNVVGIGLSYGFVEPLESTGLLTTHENILRLVTTLNQRDGYVTRTEKEGFNWICNYT

LDNFIDFVAMHYAFSMRTDTPYWRWCTQQNFYNPESVTQNVPVHQSIEQFVSSTLGEGWHPNMNGIPFIA

AGHGIKSSSYLKRTQYLLGELMADTDHLEDKRKKYLQWKEYIEKYVAQLPSHYEFLRDEIYGTP

11) Dsg13 from *euryarchaeota archaeon* TMED129 GenBank: OUV65970.1
MRVESIVIVGGGSSGWMAAAMLSKTFPKMQIGLIESEQGPIGVGESTLGHFNRFLKRLGLKDKDWMSYCN

ATYKTSIAFKNFRHGEGERFQYPFGEFDLFDYKDTLQRYFELGCKYGVDKYPPDEFANFANNQTYLADQC

KISADPIPECTYDMDRDTAYHFDAGLFGNYLRDHHCIPNGVMHLKGEIEKVMKNPDGSIDSLVTTQDGLI

KADLYDCTGFKSLLLEQHMGSEFISFKDKLFNDTALATQIPYSDRENQMETYTDCVAMNAGWVWNIPLW

HRVGTGYVYSSDYINECEAEVEFRKYLSERYTPEIAQDAKLRKINIKHGKHEKAWVKNVVGIGLAYGFLE

PLESTGLMTTHENILLLCDTLQRRQGFYSRFEQDSFNYNCDNMIESMKNFVALHYALSQRDDNKYWRDCT

NINFDIDPLWKQSTRVAHSNVVTMLDNLEDAFYNLEQHSGSIYIAAGQGYRPFSEGMFEERMSADKESDE

WSSILEEIHTKYQQDRKIMMEWVDKLPSHYEYLRDNIYDLQEEETVG

12) Dsg14 from *Gaeumannomyces tritici* R3-111a-1 GenBank: XP_009229206.1
MASVPQSCTVLVVGGGPGGSYASAALAREGIDVVLLESEKFPRYHIGESMLPSMRHFLKFIDGYEKFNAH

GFNIKKGGAFRLNWARPESYTDFVAAGGPEGYAWNVVRSEADEIMFKHAASCGVKTFDATKVTSVEFSPP

SSPEEELGRPVSATWSRKDGSSGAISFRYLVDASGRAGLLSTKYMKNRHYNQGLKNVASWAYWKGGGTHA

-continued

VGTHKEGAPYFEALKDASGWVWFIPLHNGTHSVGVVQNQDIATEKKRAMAEPSARGLYEQSLDLVPGIRA

LLSKAEMVSDVKSASDWSYSASRYALPGARIVGDAGSFIDPFFSSGVHLALAGGLAAATTIAAVLRGDCD

EATAASWAPPTPTLRVAA 13) from *Armillaria ostroyae* GenBank: SJL9408.1
MHDNRLWVFLEHWCLLFWPACRSRYTSYLSPPIPYITRKNLAISIQQLIVNRLWFQLNAMIPTKTTVLVV

GGGPGGSYAAAVLARENVDVVILEADKFPRYHVGESQLAALRHFLRFIDLEKEFDAYGFQRKVGGAFKLN

RHKREGYSDFISHDPKNYSWHVIRSESDELMLRYASRVGAKVFEETKVTDIEFGTPVEGQETRPVAALWK

GKNGDTGRIQFDYIIDASGRTGILSTQYLKNREFNNKLMNVAFWGYWTGAGRYMAGTPREDSIFVEALTD

ETGWVWFIPLHDGTTSVGVVMDQEKSNLMRAAVKEARGDSSSSAHYLRQLELAPAIRELMVDAKLIKKPD

APLVSSASDYSYAARYHAGPGYRIIGDAGAFIDPFFSSGVHLAVSGGLSAAATICAVMKGECSELDAARW

HTTKLNSSYTRFMLVVLSAYHQIRSQDSPILSAQEDDNFDLAFEFFRPIIQGNTESGGKFADDNLGKTID

FLGKHVFEPSYPEQRAELVALYGDQLDAVPKARVPGDNEAKAETKTILKHMAVQKLIRMEDVAHIGNYVS

DVFEGHRLRLKRGELGLDKAA

14) Dsg16 from *Gymnopus luxurians* FD-317 M1 GenBank: KIK62692.1
MASTHTSTIPATATVLIIGGGPGGSYAAAVLAREGINVLLLEADKFPRYHVGESQLASLRHFLRFIDLEK

EFENHGFTQKHGAAFKLDKHKREGYTDFVFDDPKNYSWNTVRSESDELMLRHAARSGATVIEETRVMEJE

WDDARPMAATWKNTQSGQMGQVKFDYLIDASGRAGICSVKYLKNRHYNPDFKNVAFWTYWSGCGEYKPGT

SRAGSPYFEALSDESGWAWFIPLHIGTSVGVVVKQELSDEKRATAKTRGLDSSLYGHYMRLLDSAPNIKA

MIANAAIIKNNNEIVVRTASDYSYHSDSYAGPHYRIIGDAGAFIDPYLSSGVHLAISSGLSAAASICSSL

KGECSEDDAIRFHNAKIDASYTRFVLIIKSVYEHIRSQKATTLSSATEDNFDDAFLMFRPVIQGRIDSSL

SLSEEDKTRLVHFYSRHAFEPSMPEERHNLLKEFGDPVKSFNNADDIHSKAILRSMAVRKLLSVDETNHI

DNYVADVVEGFRLRLERGNIGIEKCR

15) Dsg17 from *Mycena chlorophos* GenBank: GAT58269.1
MSVPASAKVLVIGGGPGGSYAATCLARENVDVVLLEADKFPRYHVGESQLASLRYFLRFVDLEQQFEDFG

FQKKPGAAFKLNQNKREGYTDFTAKDPANYSWNLVRSLSDELMLRHAAKSGANVIEETKVTEVEFKGEGD

AAQPVAAVWKNKAGETGKITFDFVIDASGRNGIISSKYKKTRVFNDNLLNVASWGYWKGTGRYAVGTSRE

NGPFFESLTDESGWAWFIPLHDGTTSVGVVQNQDISNKKRAEAKERGEDSSTSAHYHRELDLAPAVRVLM

GEATMVKKPDAPMISAASDYSYHASAYAGPHYRLVGDAACFIDPFFSSGVHLAISGGLSAAASVCAVING

QATDAEAQVYHHQKVDAAYKRFLLVVLSAYQQIRVQNVPVYSNENNFDEAFHFFRPIIQGNTDTGKQLAG

DDLKKTVEFLGTHAFEPSLPEERTQIFAKYGEEVDKLPPSMTDDNVEDTRARNILQGIAIRKLMRTEDTL

HINNETVDILGGLRMVMKRGSLGLEKAEVMA

16) Dsg18 from *Pseudoaltermonas byunsanensis* GenBank: OHU95107.1
MTATLINQAYNKHHKLVDIRLIESPDVDIIGVGEATVPAIKDFLQAAGIDEAEFMNYCNATFKNGIMFEN

WRQPKHGKMHRYVHPFDFERVEKRLDIATSWVLSERQRPFDESVSLASTLIQHNLTPKTRTTKPYHGIVH

YSYHMDARLFGQFLRQRAMAAGVTRIEAHVESVNTDNGQISSIATTQGLFESDLFIDCTGFRALLISALE

EKSSNWRSYQDELMCDSAVTVQIPHSEEHIPRSYTVAHALSCGWAWSIDLQNRTGNGYVYSSKYCSKEQA

ELEFRNYLKLDNNVALNHIDMSVGRRKRHWIGNCVAIGLAGGFIEPLESTGLHLIFLAARFLVLHNNFQY

CEANIAGFNQTMNATYDELKDFIVTHYVLSDRDDSDFWRDISKTLDACPQLAQKLDLWQSKVCEFFDVSN

STSHMFTDTSYRYILFGMDHIPQIKIPYFDGEFTDVFEFVKSRQQKAVAIALNHVDYFSYDVKGQVTVKL

SQ

-continued

17) Dsg19 from Gammaproteobacteria bacterium MedPE GenBank: OIQ47327.1
MPQKAIKTLVIVGGGSAGWMSASFLNHIFNLKEKQIDIKLIESSEVETIGVGEATIHSIRFFLSTIGISE

REFMQKTQAIFKHGILFKDWSGQEKDEYYHPFEHPKVNDGIDVVRHWVNLNSNTEKSSRFDFSVSAQSLC

ASQNKSPKSQGNKDFEGYFPYGYHLDAAKFAHFLRDFSLTKGVKRIEGHVQEVILGTDGDIQRLILKNGL

QIDGDFFIDCTGFSSVLMKAMGNKEWVDYSDSLLCDRAVTCQLEHNKENQEHRPYTIATAQKSGWIWDID

LQSRRGMGYVYSSSFCSTEQAEIDLSVYANTAREKLSFKHLQMKTGRMEKIWFKNCLAIGLSAGFIEPLE

STGIYFIDMGIRFFGDYITSGNVNTLLIDKYNTVMGQLMDQSKDFISLHYTLSKRNDSQFWRAYQHDVPI

SETLSANLTLWKHKIPTAIDFSAQITQFTSANYTYILYGMKYFPEPAVTSNLFTSEDRSMKNIEYVKSRS

NQMNNKLPTMSQFLKNI

18) Dsg20 from *Asticcacaulis* sp. AC466 GenBank: ESQ83834.1
MFMNSVQQQEIVILGGGAAGWIAAALLARKTDRSQTRVTLVESEEIGIIGVGEATVPVLAHCNALLGIDE

YDFIRNTQGTFKLGIEFCDWGVAGNRHFHAFSDYGHQVDGVSTHHYWLRLRQSGDAHPIDDYSFAYAVAK

NNNFAPTDPQNPRYHHAYHFDAALYARYLRDVATGQGVQRIEGKMTHFDLESASGNITAIHLANGSRVPG

DLFLDCTGFASELLGKALETPFVDWSRWLLCNSAMAVPSKRTGAPMPFTRSTAHAGGWRWTIPLQHRCGH

GMVYNSDLWSDDAARDALTGNVDGELLAEPRVFRFTSGHRKQFWNRNCVGIGFASSFLEPLESTGLQLIV

QGVLKLLQFFPQRIIDPVLRDEYNRISTREIERIRDFIIAHYYLSRRPEPLWAACRNIEVPDSLRHKLEV

WNASGQIALGDLESYMEPSWLAILLGNGVVPARYAVAADLYPLEQIRKGMKLRREEIVRSAQAVTSHQDF

IDQYCKAP

19) Dsg21 from *Marinomonas mediterranea* WP_013663195.1
MKKRIAIIGAGLSGIAAIKQLTDEGHHVVCYEKAESFGGVFAAKKIYEDLHLTISNYFMAYSDFLPTEQS

LKFWSKQEYVQYLKRYLAHFDIEKHIVYNHKVVNAEQNGDKWTVKVQSGSGEETESEFDMVVVCSGHFQE

PKTPDLEGLSDFMGDIIHSNDYRDKMAFKGKRVMCVGLGESSADITSEISEVAEKCILSLRRYPAVAPRY

MAFQEDPYFTIDTSWLTSRIVNKLPFSYHRGITKNIFHKYVNSRNLHLRIRGEWLHKSGPSIHQAVTKNE

RLFKPIAEGKVLPNIGGIERFEGNTVIFKDGTHEEIDAIVFCTGYKLSFPFLQHKIECMRDLYKQIFIPS

VGSSLAFVGFVRPQQGGIPVIAEMQSRYLAQLASGVKSLPSLEKQKEVIMEDANHWETEYHITPHVASLV

NYCHYMDSMARLVGCMPKTPSLLKDPLLRVKLLHNPQFAAQYRLEGPHPMSESSRDFLVNFPNISTWPRI

IHFECALAMQKLLSFLSMDNLRELKK

20) Dsg22 from *Armillaria solidipes* PBK71279.1
MIPTKTAVLVVGGGPGGSYAAAVLARENVDVVVLEADKFPRYHVGESQLAALRHFLRFIDLEKEFDAYGF

QRKVGGAFKLNRHKREGYSDFISHDPKNYSWHVIRSESDELMLRYASRVGAKVFEETKVTDIEFGTPVEG

QETRPVAALWKGKDGDTGRIQFDYIIDASGRTGILSTQYLKNREFNNKLMNVAFWGYWTGAGRYMAGTPR

EDSIFVEALTDETGWVWFIPLHDGTTSVGVVMDQEKSNLMRATVKEARGDSSSSAHYLRQLELAPAIREL

MVDAKLIKKPDAPLVSSASDYSYAARYHAGPGYRIIGDAGAFIDPFFSSGVHLAVSGGLSAAATICAVMK

GECSELDAARWHTTKLHSSYTRFMLVVLSAYHQIRSQDSPILSAQEDDNFDLAFEFFRPIIQGNTESGSK

FADDNLGKTIEFLGKHVFEPSYPEQRAELVALYGDQLDAVPKARVPGDNEAKAETKTILKHMAVQKLIRM

EDVAHIRNYVSDVFEGHRLRLKRGELGLDKAA

21) Dsg23 from *Colletotrichum higginsianum* CCF36327.1
MSPAIPERCTVLVIGGGPGGSYAASALAREGIDVVVLEGDKFPRYHIGESMLASMRHMLRFIDLEAKFDS

YGFIKKPGASFKLNKDKRPGYTDFLAAGGPNNYAWNVVRSEADQLMFHHAGECGAKIFDAVKIKSIRFED

ATTVPEGEPNLNPGRPVAAVYEVAETKETGEIAFDYVVDASGRVGLLSTKYMKNRRYNQGLKNVANWGYW

EGCNKFSPGTPRENSPFFEALTDESGWAWFIPLHNGKASVGVVMNQKLAAHKKQQGGFNSTEFYHESLKL

APELLSVLVGDGKFVSDVKSASDYSYSASSYAFPNARIVGDAGCFIDPFFSSGVHIALTGALSAATTIAA

SIRGDSEEATAAEWHSKKVAAAYTRFLLVVLSAYKQMRFQGDPVLSDFDEDNFDRAFSFFRPIIQGTADA

-continued

ANGNLSQDELNKTLEFCAHAFEPVNPEANQEKVMKAVSAAPAGSDYNPDLSVEEQNAVNHIRARKMMRTE

DTFNINTFGTDSIVGYVPNLVRGSLGLKKAETNGVVAA

22) Dsg24 from *Suillus luteus* UH-Slu-Lm8-n1 KIK37366.1
MAGQTLPTSTQILIVGGGPAGSYAAAALAREGFEVTLLEAVQFPRYHIGESLLPSVRHFLAFIGAEESIM

NYGFTVKPGAAVKLNQFKREGYTDFVALNPNNGSWNVIRSEFDDLLFRHASNSGATVFDNTRVTEFQFEG

ERPVSASWRNAITGVEGRISFSYLVDASGRNGIMSTKYLKNRRYNKALNNVACWGYWDGTGSYMPGTTRE

NAIFVEALKDESGWAWFIPLHDGSTSVGIVMDSESSNRKKKASRAASGGSGSNILAHYKEELLSRAPGVL

KLIGTATLRNDGTPEAVKSASDFSYSAPSYAGDHFRLAGDSGAFIDPFFSSGVHLAFTGGLSAALTIAAS

IRGFCSEEDAQRWHTSKIATSYTRFLLVVLGTYKQIRNQAMPVMSDVDEDNFDRAFDLIRPVIQGTADVG

KALTEDELQKTMDFCRHLFAPTNPEMHSAVKARLDPSLTSPDAPVMTESDIDSLLGDADEEEAKLVLSEIN

ARKPIHTMYNPTENFGVEAHFGFKAVLERGKLGLAST

22) Dsg25 from *Streptomyces glaucescens* WP_078957599.1
MSMRKSVCVIGAGPSGLVAIKELLDEGHSVTCFEHSAELGGVFRAEVGADEAGAYDSTMLTISNYMMTFS

SFPPPQGQDRRYWSAGEYRQYLLDFAEKFGLGPAIRYRTDVLSVSRNDSGGYTVEVAPVDDPEGRAAHQF

DAVVISTGTHRVPNYIDLPGQEEFAGEIVHSAHYRNADRFRGKRVLCVGIGETAADVVNEIAQVAASCTL

SVRRYQPIVERYPGDRPFTNDAYTSHLLHSVPLAAAGPLMHLGMKRNRTRGKTAAARAVAAWNANNPDFF

HHFLTKNDAFVHRIVDGTLTVDASGIQRLGKDYVVFRSGRRETIDTVMLNTGYTEDFSILKDVDVTDVRR

LYKHMIHPELGTGVVFIGWARPAAGGVPACSEMQSRYFALLCSGKKKLPDRVRLQGLIERQAAYENEVFH

GNPDLRTLVHYNHYMIDFAKVIGCSPWRPSLLLDPRLALRLWCGSQTPHVYRLSGPHSDRRTARRTVMSL

PPAFTPAQIALTTAVSAVSRVLIRLGLMKADPVY

23) Dsg26 from *Moritella viscosa* WP_082293722.1
MSKRIIMQTQQKNICVIGAGCSGLVAIKELLDEGHQVTCFETLDKPGGNFYCSDNVEISGSYDSTMLTIS

NYMMAYSSYPPALSEQRKFWSAREYQEYLLDFTKHFSLDQHITYENAVNNVKKLDNGKFHVDVRSTHDET

QVSSFTFDAIAVCTGSSRVPKYIDIKGLETFKGDVYHSAFYKNSKPYTGRSALCIGMGETGVDVASETAG

VAGKCMLSLRQRQPSVERFPLAKEHPSDAYTSHFLYAMPVSAGNARMKLQFKAMKKFGKEEKTRAFADWN

LKAGNYFNYFNLKSDVFVDRIVDNKMAVNTSGIDYLGEDYVAFNDGHKESIDMIMLNTGYTDKFDFLEDI

KLPDMRQLYKHMIHPDLGCDIVFIGWARPAVGGVPACSEMQSRYFALLCSGKKQLPEMHKLKQLIAQQAF

YEDEVYFKNRNVRSLVHYTGYMADFSKVIGCSPWRLSTFLNPILTYRLWVGSQMPSFYRLYGPHSNYDKA

KKSIFNVPIAFNLIEAAVLTTYTLLTRGLATLGIIKADPKY

24) Dsg27 from *Chaetomium globosum* CBS 148.51 XP_001225800.1
MSIPQSCTVLVVGGGPAGSFASAALAREGIDVVMLEADKHPRYHIGESMLPSMRHFLEFIDCYEQFNAHG

FIKKNGAAFRLNKTQPEAFTDFIAAGGPNGHAWNVVRSEADELLFNHAASCGVRAFQTTKVDAVQFEESD

GETAGPGRPVSASWKRKDGTTGTIAFKYMVDASGRYGLLSTKYLKNRKFNQSLKNIANWAYWKGGGIYAE

GTHKAGSPFFEALQDASGWCWFIPLHDGTHSIGIVQNQEMATEKKRAAGSPSTKEFYTQSLDLAPGIKAL

LSKAEVVSDVKSASDWSYSADTYAFPYARIAGDAGAFIDPFFSSGVHLAVLGGVSAAVTIAASIRGDCDE

KAAASWHSKKTAESYTRFFLVVSSALKQIRMQEDPVIQDLDEEGFQRAFDLFRPVIQGTVDAHHNGKLTQ

SETSNTVEFCFKAFTHVTPEQKDAVVNKLRKLSANAEAGDEETIDNALGEIEKSLTPDELQVLNILRGRR

MIREDGYNMDSFTLDTIDGLAPRMERGKLGLAKSQAARLSKAHLYSADYLEGKRPGVRVVQPAKSMNGAN

GHSNGEANGHTNAANGTNGVNGANGTNGHTKEHANGHENGSGMNGAAKATFNAANGAGLFASPINGQAAQ

LDDVGRHALMNTLHEAAENLETPFDLVMRLGNSARLLTYIRVAHTLNLFATLSNASPTPVPLTTLTSTGP

APGAAPTFIRRVLVFLAANRLIGEAGPDLFVATKATHSLALPGVAGGATFYQGVIAPMTQYLPESPLAKC

GYVQRAGEPAVFDSWSAGVEGGGRGLWPYLKGRPEMLGAFQELMALDRGGGDWVGCVDFEGVDSPSLVMG

-continued

GEGGGGSERVVFVDVGGNVGHQARRLVERHPRLAGRVVVQDLPETVAAAPAAKGVAFLAHDFFEPQPVRG

ARYYYLRSVLHNWGDAQAVEILKNVAAAMVEDSRVLIDEMVVPDKSADVLVAGQDLNMMLLFGGMERRTD

DWAALLDRVGLKIVEVKMYGPVTKNSIIVAMLK

25) Dsg28 from *Pseudomassariella vexata* GenBank: ORY71356.1
MIATIPEKCTVLVVGGGPAGSYAASALAREGIDVVLLEADKFPRYHIGESMLPSMRHFLKFIDAYEKWDA

YGFNIKKGGAFRLNWSRPETYTDFVAAGGPGGYAWNVVRSEADELLFKHAAECGVKTFDETKVASIEFAE

PASSDSQNFGRPVSATWTRKDGTTGTISLDYVVDASGRAGLISTKYLKNRSYNQGSKNIASWGYWKGGGV

HGVGTFKEGAPYFEALKDGSGWVWFIPLHNGKHSVGIVQNQEMATKKKREMAEPSSAGFYKQSLELVPGI

KELLANAELVSDIKSASDWSYSASSYAFPGVRIAGDAGSFIDPFFSSGVHLALSGGLSSATTIAAAIRGD

CNEEKAASWHDKKTAESYTRFLVVVSSALKQIRSQDQPIINDFDEQSFERAFDLFRPIIQGQVDADARGK

LSQAEISKTVEFCFKAFAHVSFEEKEALIAKLKQLGLDGDAYDESNRAALDAIEKKLTAEEQSILKTLKG

RRMVRPEDSLNIDNFTLDSIDGLAPRLERGRLGLQGAKKAQVKFTAHDSLSFLNGEARAANKLQNGHAAA

NGTGHANDHANGHASDHANGHANGHSDIHGVEKSLVDLVMSEERLPSASLDESSRHRLMSSLHESAEELE

TPYDTMLRFVNAGRQVALIKIGGDLGIFKSLADSKTPLCSTQLAEGTGADPTLFSRIMRYLVANRLVAEV

SPDHYVARKTTHALADPRIESPMRFFHAVSNPAFQALPDFLRETGYQNQTQRQALQKGLGTELGLFPWLK

QRPDLLRDFQSLMGVPKEGNCLDVIPLDDSVCSGHKGPVFVDIGGNTGQQAGGLVAKYPALAGRVVVQDR

QETVNSATGVKGVQFMAHDFFSPQPVKGAKYYYLRAVLHNWDDDKAAQILANIVPAMSADSLVLIDEVIM

PDMGAHVWPAGLDLQMYTLFGASERTAKQWDALLQRAGLQPVSVKKYAPVMGSSVIFAAPK

26) Dsg29 from *Ophiocordyceps australis* GenBank: PHH66063.1
MASIPEKCTVLVIGGGPAGSFASSALAREGINVVLLEAEKFPRYHIGESMLPSMRHFLKFIDCYEKWDAH

GFNIKNGGAFRLNWSRPETYTDFIAAGGSQGYAWNVVRSEADELLFKHAGECGVKTFDETKVASIEFAPR

EADAPEKQPFGRPVSATWTRKDGSSGVIAVDYIVDASGRNGLISTRYLKNRAYNQGLKNIANWGYWKGGG

VHGVGTFKEGAPYFEALKDASGWVWFIPLHNGTHSVGIVQNQEMATAKKRKMAEPSSKGFYLETLELVPG

IKELLAKAELVSEIKSASDWSYSASNYAFPGVRIAGDAGSFIDPFFSSGVHLALSGGLSAATTICAALRG

DCDEKFAASWHDKKTAESYTRFLVVVSSALKQIRAQDQPVINDFDEDTFERAFDLFRPIIQGQADSDFKG

KLSQAEISKTVEFCFKAFAHVSYEDKEALVKKLKDLGLDGDAHDEKNRQALDELEKKLTPEERSILTTLK

GRRMVRPEDSLNIDNFTLDSIDGFAPRLERGRLGLASAEKAKVKYTTHDSLSYLNGEARAANKVPANGAV

VKNGCNGANGHHAANGVNGSANKNMAALVADDENLPQTTLDEASRHKLMSSLHESAEQLETPYDTMLRFL

NAGRQVALIKLGGDMQIFKSLVDSKTPLSSAQLAKPTAADPRLVARIVRYLAANRLVAQVAPDQFTAQQT

THTLADPRIQGPMRFFHAVSNPAFHALPDFLQETGYQNKSETCAFQRGLKTDLGLFPWLKQHPDLLKDFQ

SLMGVPKEGNCLNVISLDASVSSEHRGPILVDIGGNTGQQAGNILAKHPELAGRVVVQDREEAVKNASDI

KGCQFMAHDFFKPQPIKGAKYYYLRAILHNWDDEKAAQILANIVPAMTADSLVLIDETVIADEGAHVWPA

GLDLQMFTLFGATERTTTQWDAILDRAGLRPVAVKRYAPVMGSSVIFAAPK

27) Dsg30 from *Colletotrichum sublineola* KDN62803.1
MASVPQSCTVLVVGGGPAGSYASAALAREGIDVVLLEAEKFPRYHIGESMLPSMRHFLKFIDGYEKWDAH

GFNVKKGGAFRLNWSRPETYTDFIAAGGPDGYAWNVIRSEADELLFKHAAECGVKTFDATKVTSIEFSSP

GEGSEADGKKLGRPVSATWSRKDGSSGTISFDYLVDASGRAGLISTKYLKNRSFNQGLKNIASWAYWKGG

GVHGVGTHKEGAPYFEALKDASGWVWFIPLHNGTHSVGIVQNQEMATKKKREMDEPSSLGFYKQSLDLVP

GIKELLSKAEMVSEVKSASDWSYSASSYAFPGVRIAGDAGSFIDPFFSSGVHLALSGGLSAAASIAAAIR

GDCDEETAASWHDKKTAESYTRFLVVVSSALKQIRSSDQPVLHDFDEESFERAFDLFRPGTFPVARGMKK

FNQHSLTLYRPAVIQGQVDADTKGGLTQAEISKTLEFCFKAFAHVSFEEKEALVNKLKELGLDGDAYDET

NRQALDELEQKLTPEEQAILKTLKGRRMVRPEDSLNIDNFTLDSIDGLAPRLERGKLGLAPAKKAQVKYT

-continued

THDKLSYLNGEAGAANKLESNGHHKPQGNPTVTNGHGATNGHSATNGHSATNGHSATNGHSMTNGHNGVT

EHTSYNATHVADLVASGNESGKITLDERTRHSLMSSLHEKAEELETPFDTLTRLVDAGRQVALVKLGSDL

GIFKSLAESTTPLSSGQLAEYKEADPLLVSRIVRYLVANRFVGEVAPDRYVSRKATHALADERIASSLRF

FHAVSNPSFQALPDYLRETGYRNRTAGSALQKGLAAEQGMFPWLKQHPDVLADFQNLMGIPKESNGWDVI

PLDMSLSANHQGPVLVDIGGSTGQQAKLLVAQHPELAGKVVVQDREETIKGAPAIQGVDLMAHDFFKPQP

VKGAKYYYLRAILHNWDEDQAVQILANIVPAMSNDSLVLIDEVVISEKGAHVWPAGLDLQMLTLFGASER

TGPQWDTLLDRAGLKPVSVRKYAPVMESCVIFASRK

28) Dsg31 from *Pseudogymnoascus* sp. VKM F-4246 KFY11174.1
MSVPQKCTVLVVGGGPSGSFAASTLAREGVDVVVLESENFPRYHVGESLLPSMKHFLKFIDLYDQWNAHG

FIKKNGAGFKLNHAHGAAYTDFLAAGGPHGHAWNVVRSEADELLFRHAGVSGAKIFEATKVNALQFEPYN

GPTMPDVPNPGRPVSATWSSKDGSSGTIAFDYLVDASGRFGLVCNKYLKNRKFNQSLKNIANWGYWKGGG

IYGVGTHKEGCPYFEALTDGSGWCWFIPLHDGTHSVGIVQNQEMATAKKREQGSPSTKEFYKTSLDLVPG

IKELLSNGELTSEIKAASDWSYTASTYSLPYVRISGDAACFIDPPFFSSGVHLGVLGGLSAAVTIMASIKG

ECDELAAATWHTKKVTESYTRFFLVVSSALKQIRSQTAPVIQDIDEDGFQRAFDLFRPIIQGTADADSGG

KLTKADISQTMDFCVKAFTHVSEEQQGALMKKLKAHGLDERLDDEAAKKVIDELEKDLTEEEQQVLNVLR

SRRMIHEDSFNLDSFTLDSIDGMAPNLVRGKLGLIKQETAKISKATLYSTTFLEDMTPGTRTHRAEQTIN

EHQYSGRDTYTNARSSVLASAANR

29) Dsg32 from *Daldinia* sp EC12 GenBank: OTB14557.1
MNVPQKCTILVIGGGPSGSYTAAALAREGLDVVVLEADTFPRYHVGESMLPSVRPFLKFIDGYDKWIARG

FRIKNGGAFKLDHSRPDTYTDFVASGGPEGYAWNVIRSESDELLFNHASSCGAKTFDSTKVNDIQFDPAN

VAPNFDGQIPGRPVSATWTRKDGSSGIIRFEYLVDASGRHGILSTRYLKNRKFNQGLKNIANWGYWKGGG

VYGTGTYKEGSPYFEALTDASGWCWFIPLHDGTHSVGIVQNQEIATAKKREAGCESTKEFYLQSLNLLPG

TKELLSKGELISDIRSASDWSYSASSYAFPYARIVGDAGSFIDPPFFSSGVHLALNGGLSAAVTISASIRG

DCDEETAASWHSKKITDSYTRFLLVVLSATKQIRHQNRPVIHDFDEDSFERAFELFRPVIQGTVDADVIV

KPTQEEISKTVEFCFRSLADIPPEHKDALIEKLKSLGVEGEADDESTLRAIEEIEKNLTLEESQILNILR

GRRMLRNEDSISLVNFTLDSIDGLAPRLEQGNLGLVKAAPIKASKAQLYSASFLRGGRPDIRTQRGDKVS

RELGNDSAVSN

30) Dsg33 from *Hypoxylon* sp. CO27-5 GenBank: OTA94904.1
MSIPQNCTILVIGGGPAGSYVAAALAREGLDVVVLEAEQFPRYHIGESMLPSMRHFLKFIDGYDKWNDHG

FRVKNGGAFKLDPGLPDTYTDFVASGGPEGYAWNAIRSEADQLLFEHANSCGAKTFDATKVTSIDFEPYV

ATDATSKFEGPNPGRPISATWKHNDGDSGTISFDYLVDASGRRGILSTQYLKNRKYNEGLKNIANWGYWK

DGGVYGPGTYKEGSPYFEALNDASGWCWFIPLHDGTHSVGIVQNQDSATEKKKAGDCPPTKEFYLQSLEL

APGIRELLSKGELVSDVKSASDWSYSASSYAFPYARIAGDAGSFIDPFFSSGVHLAFNGGLSAAVTIAAA

IRGDCDENTAASWHTKRIAESYTRFLLIILSSTKQIRNQNKPIIHDFDEESFERAFDLFRPIIQGTVDAD

VKRELTQDEISKAVEFCFRSFADFSSEKKDALIEKLKGLGLEDNEDVEKSATAIEEMQKSLTPDESRILD

ILRGRRMIRAEDSINLVNFTLDSIDGLVPNLERGKLGLIQATPVKTNNASLYSVKYLRGGRPDIRTQRGD

KTSKAPEETTDEGSIPK

31) Dsg34 from *Coprinopsis cinereal* okayama7#130 XP_001838319.1
MGRTSPSSLRTQVLVIGGGPAGAYAASVLAREGFQTTVLEATKFPRYHIGESMLPSVTSFFEFIGLDEKL

RNHGFCSKPGAAVKFNQRKKEGYTDFLKNNSEGTWNVVRSEFDEMLLRHAGESGATVLEEHKVIEIKFED

VSGKSRPYSAVFTRPSGERSEIHFDYLIDASGRNGIMSTKYLRNRKMNSSLHNIACWGYWEGGYGKYMPG

TRRENAPWFEALTDESGWAWYIPLHNGTVSVGVVMDQDVSSSKKAKAREASATGEHTLCDHYLQQLELVP

GLKALLGTATLVSNHVKSASDYSYSAERYAGDRFRIIGDASAFIDPLFSSGVHLALLGGLTAASTVAASV

-continued

RGHCSEEEAAEYHHVKIGAAYTRFFLVVMSAYRQIRSQNVDILSDVDEDNFDRAFDIIRPVIQGTADVGR

TLSESELQKTLDFCKDVWAPVDPEMHERVASRYGSELLSPAAPIFKPEDLDQIVDPNDEDAVDVFKRANA

RKIVDPMFKGISSLESEPVKGFITCLQRGSLGLIYIASAA

32) Dsg35 from *Sistotremastrum niveocremeum* HHB9708 GenBank: KZS96629.1
MPVPTNPQNSIPSRTKVLVIGGGPGGSYAACALAREGIDVTVLEASRFPRYHIGESMLPSVRPFMQFIGC

EQKIIDHGFTLKPGAAVKFNQWKQEGYTDFVALDPDNAAWNVIRSEFDNIIFEHAAESGANVFQQVKVTS

IDFAPDSPPPSPPATLTGPRPVRAHYTRTHSGGATTTGTIEFDYLIDASGRNGMMSTKYLQNRKMNESLK

NVACWGYWRGGAMYMPGTTRENAPWFEALTDESGWAWYIPLHNGTVSVGIVMDQSISNAKKAKSKAAAAP

KEFTLTDHYHEQLQAFAPHLCKLLTKAHLVTDDGPAVKAASDYSYAATSYAGDHFRLVGDAAATLAFIDP

FFSSGVHLAFTGGMSAAASVASSIRGQTTEAEAAGYHDAKVGVSYTRFLLVVMGAYKQIRAQSQPVLADV

DENNFDRAFSIIRPVIQGTADAGKRLTENELQKTMDFCKHIFSPTDPEMHEAVGARVDPSLFSPEGPVMT

PDDLDRVLDPNDDEARAVLQEVNARKPVHIMYNATGNFDMEDVNGWKVTVKRGNLGLRRA

33) Dsg36 from *Scytonema hofmanni* WP_051502977.1
MSTLPKFTQVLVIGGGPAGSTTATLLAREGFDVTLMEKAVGPRYHIGESLLPSSMEILELTNAKEKVEAY

GFQRKEGAYFEWGTDKWSFDFGQLNGKQKYSYHVRRADFDKLLLDHATSQGVKVFEGTEVRELSFNGARP

QSAIWSQNSGDNSSGEISFDILVDASGRAGVMATRYLKNRQQNQVFQNIAVWGYWKGAGKVTEAPAGAFV

GGSTEDGWLWGIPLHDGTLSVGVVMHKESYKARRSTSLEEFYLGAIAESPLMTKLLTQAELVSSVQAEQD

YSYAAENFCGSGYFLIGDAACFLDPLLSTGVHLANLSALLASASITSLLRNEVSENQAISFYEKSYRQAY

LRFLSLVSFFYDKKRGTDAYYEEAQELAHNDYRDSAPNTAFVNLVSGMEDLTEAQNGIDNLVIEKISQRA

ARSLSLEQVQEDLDGEKMDTQIMNVMEGMYTFSKDLSVEAAIDGFYVVTRPRLGLGRVSEKVEESAQKRL

ADSNAPSPSIR

34) Dsg37 from *Tolyprothrix* sp. NIES-4075 WP_089131087.1
MSTLPKFTQVLVIGGGPAGSTTATLLAREGFDVTLMEKAVGPRYHIGESLLPSSMEILELTNAKEKVEAY

GFQRKEGAYFEWGTDKWSFDFGQLNGKQKYSYHVRRADFDKLLLDHATSQGVKVFEGTEVRELSFNGARP

QSAIWSQNSGDNSSGEISFDILVDASGRAGVMATRYLKNRQQNQVFQNIAVWGYWKGAGKLTEAPAGAFV

GGSTEDGWLWGIPLHDGTLSVGVVMHKESYKARRSTSLEEFYLGAIAESPLMTKLLTQAELVSSVQAEQD

YSYAAENFCGPGYFLIGDAACFLDPLLSTGVHLANLSALLASASITSLLRNEVSENQAISFYEKSYRQAY

LRFLSLVSFFYDKKRGTEAYYEEAQELAHNDYRDSAPNTAFVNLVSGMEDLTEAQNGIDNLVIEKISQRA

ARSLSLEQVQEDLDGEKMDTQIMNVMEGMYTFSKDLSVEAAIDGFYVVTRPRLGLGRVSEKVEESAQKRL

ADSNAPSPSIR

35) Dsg38 from *Fischerella* sp. NIES-4106 WP_096680287.1
MSTLPKSTQVLVIGGGPAGSTAATLLAREGFDVTLVEKAVGPRYHIGESLLPSSMEVLELIGVKEKVDAY

GFQRKDGAYLEWGSESWSFEFTKLNGKQKHSYQVRRADFDKLLLDHASSQGVKVFEGIEVRELSFNGTRP

RNAIWSQTSGGNSSGELSFNFVIDASGRAGLMATRYLKNRRQNNVFQNVAVWGYWKGASKLTKGPEGAIG

VGSIPEGWLWAIPLHDGTLSVGVVLHREAYKAQRSASLKEFYLNAIAECPLVAELLTQAELVSSVEAEQD

FSYTSESLCGPGYFLVGDAACFLDPLLSTGVHLANFSGMLASASIASVLRNEVTEDQALSFYEKSYRQAY

LRFLMLVSFLYDQKRGQKAYYQEAQELTHNDYKADAANAAFVNIVSGMEDLTEVQDGIDYQVTKKISQRV

AKSISIDDFRKNYDPEVLDPQIMQAMEGTLSFSKDLSVEAAIDGFYIVTQPRLGLSRVQHKAEELLSSEL

FHS

36) Dsg39 from *Mastigocladopsis repens* WP_017317771.1
MSTLPKSTQVLVVGGGPGGSTAATLLARQGFDVTLVEKEITPRYHIGESLLPSALEIFELLGIRDKVESY

GCQQKEGAYFVWGPRQWGIEFQRLLNKYTFQVRRGRFDKLLLEHASEQGVKVFDGIEIRKLSFDGERPIS

ATWSSGGMNGSSGEIAFDFLIDASGRSGLMSTQYLQNRRYHKEFQNIAIWGYWKNVDFSKIWPENGTVSA

-continued

RTEDGSGWIWAIPLSDDTLSTGLVLNKEIYKQRKSQASLEGIYAAGIADCPYVSDLVKTAELASPIKVEQ

DYSYVADKFAGPGYFMLGDAACFLDPLLSTGVHLAFFGGMLSAASIGSVLRNEVTQEQAYSFYDKTLRFH

YLTLLVFVSSFYHITGNPEDMDMDADPSAGPRRFIAEVEDLQKVEPQMRQLVSEHMVELLTKAEEGVRLM

VAEELEGTAKLSGELDPKHQAVFLQLWRGVFGYLPDFDGLRLKTQTNLRLVSVSEDDAAALTLDTVLDEK

YYAQQEADMALTK

37) Dsg40 from *Moorea producens* WP_070392566.1
MTLNNSDTFKMFDAIVIGGGPAGATCAYKIAANGHSVLLLEKAKFPRFHIGESMVPYLYKLFEMIDISDK

IKEGGFVQKNGVEFLTGTTGDLRRQNFGNVAKGQTPFSYNLNRARFDKILLDHAQDTGAQVLQEADVKKL

IFDGERLAGVEYQYQGCRHEARANFVVDASGRAGLIAKHFNLRKMNNKLQNVAVFQHYKDVVAENNPGVE

GDVLFSCHEDGWLWGIPIETNVMSVGAVMPLSILKQSNPEEIFKAHCDRSPRIKSAIKGATPLFNKPKVE

LDFCYYSEQFTGPGYFIVGDAACFVDPVFSGGVFLSMLCGLKAAEAIHEIFDGKDDLEACQDFENLCKTG

YDSYFRVVYSYYYEFNRDMNKMGLNLPGGFRFVLQTFAGDFWAERDQPVLSYLRSKKEWDTFEQPFERIY

DCPIYPDTHYKAADPASFTPPEDFLESINTQTQTETQKAAVL

38) Dsg41 from *Calothrix* sp. PCC7507 WP_015131184.1
MNIPQQCDVVIIGGGPAGSTAATILARKGYKVVLLEREKFPRERVGESMLPFCYELFRELGVLAQMEKRF

VRKPGVRFINSDGSASTYWCFNHVIKDESYLSFQVNRSEFDTILLENSRKHGAEVREETRVDVCSLEVEG

STDKVEVQAISRNGERLSLQTRFVIDASGRSGFIASSKGWRKGHKGFARTALWTHWKGIKSLKGGLEEGS

SIILYLGGEKRGWAWVFPLGIDWVTVGVVMDTAYLNHKRQELQASSIKDWCTELYQQELYSSEFIRELLA

QARISMPVQVEGDYSYYSENKFSTKYAMVGDANRFLDPIFSSGVFLSMKSSFLVANAVDKMLLSNQANDM

SYLEEAYAKINGAYDFVYRLISLFYQPHALSWAEAGATFNSVSQIDYKRHEVAMGAGHYMLAGDFFENHE

KYHKFLDMMENPRFFEGYKNLVVDREEYQTESCGAERSIIFP

39) Dsg42 from *Fischerella thermalis* WP_102149226.1
MNHSYYDVVVIGGGPAGSTLATLLVRKKYQVLVLEREKFPRFHVGESLLPATQLIWEKLGIAEPLQHLGN

TFKYGTEIRMGLNPQQSEYEYSRQEFYKFPTQRLQQQPYAYQVERSEFDLFLLNHAREEGATVFEEAVVK

EVLWEDDTATGIHWKSKDNIEYTTKAKFIADCSGRYGLITKSRKFLIPNKTIKTSAVFGHFKHVTRASGI

QQGYFNGYVIENGWIWFIPLASDIMSVGVVMNEPGTSWWKQKSPEEILLTYIQQYKFIRERFEQAEQFSK

VRMLRDLSYASKRSVGDGWILVGDANFFVDPLFSSGVHIAFRSAEKAADAIDEFLKNNRDRKSLQQYEKW

SQKEHFHVSTTMALMYKMLKYRISMQLLIKLTGKYSNHWDNLLLRRLVAWGSGYYEEFHWTLYCSWLFCF

LLIGIGKVCEKFLGISGWSTQPEFCSKSPLTFPKSVESLKNKHPEI

40) Dsg43 from *Nostocales cyanobacterium* HT-58-2 WP_087539197.1
MKDKKQYDVIIIGGGPAGTTCATMLSREGHEVLLLEKYKFPRFHIGESITAFGANAFKKLGIYGELKQIG

YVKKKGAEFIFQEKSYSAYFNKSFQNESDELPWAFQMARSKLDLLLLENARKSGATILEQHVVKRVLFNG

ERAIGIEYKDLSKDAINPPLQYAYAKWIVDASGQAGMINKQVENNCYNDFLLNKKLAIFNHWEGDFEITN

TDEDVNFKFCIHENRRDWAWYIPIDKNIVSIGVVLSEESIKNRTEGLEGVFYKYAEQLPFISDFLKNPTL

KPIDKFRSARDYSYRCKQYYGDGWVLVGDSAGFIDPIFSTGLQIAFSSAFMLVDALHEVLSQKSPNYSKL

KAYNRNVNKLYKINSMFVYLYYLSGLEFEKLWSISHMWKYLKWSGLKYPVLFFWYALQIRIASKKQARIW

GDEVLFGIIKSQNPLANLLLALSENYERLQNRRAKNVISRNQFLEMEV

41) Dsg44 from *Nostoc* sp. *Peltigera membranacea* cyanobiont' 213
WP_094331718.1
MNIPQQCDVVIIGGGPAGSTSATFLSQKGYDVVLLERHKHPRHHIGENTIPQFWKYTDLAQVSDKIAAEG

FTQKAGGTTFWNGRIRQVDFKDFGYSRQALHVERDRFDLILLENAREKGVQIFEEVSVLSVDLQDGQQEQ

SLTYRLLKDKSLGKITCRFIVDASGQNAVIAKQMGIRTIDKDFRFMSLWGYFKNSKYIGLNGKAHSVENL

RTILPTTFICSFAETGNWGWSWHIPLRESTSVGLILPLEFMKTVQLNGGSWESYFRQKCCEIPILEDLLA

-continued

NAQFCEGSFAKIQDYSYRSTQLAGPGFFLIGDAAGFIDPIFSIGIVLGMYSAYTATWAIDRSFKNPSSLV

HNQALFSSQLQGRLEVARSLALPHYQSGDRACDLAKTTIQMERALEQELMATWSTMTTRPENFQAIASSL

KGREINSNKFRVIEEMI

42) Dsg45 from *Cyanothece* sp. PCC 7822 WP_013322009.1
MNYETATIGGGPAGASLATYLARAGKSVAIFEKSDFPRFHIGESLLPATMPILQDLGVYERMRSTFLNKP

GGCWYYDDTPVMSDFAKCRETASFKDFRHAFMVERGEFDRILLDNARDHGVRVFQHHLVREAIWEGERMT

GLQVKDLQTMEGKSIRTEMVFDCSGYRSVIASQRNLRKPNRLKKMAIFAHYRAEALEERLKQGWFVGQMF

YDGWLWLIPIDKDRISIGVVTTLDNYKKASISPEQFLDHYIRTLSLTRKGLGKNIERVSDIYLYGNLGYS

SERIFGDRWALVGDAAVFIDPCYSSGVHLAMDSAREIARVYLEHGYDARSLQNALSKYEKRLRQHEELVL

MLVDSFYMASRNKFLRFLVKNLSKISSLNQKFVHFTGGDLADDPGYIKMTYYTHLAISALANVFQRQPSA

APEKGKSAVLIK

43) Dsg46 from *Planktothrix agardhii* WP_051340019.1
MNIPQRCDVVIIGGGPAGSMAATFLSQKGYDVVLLERCKYPRHHIGENIIPQFWKYTDLAQVSDKIAAEG

FIQKAGGTSFWNGLIRQIDFKDFGYSRQALHVERDRFDLILLENAQNKGVQVFEEVSVLSVDLQDGQQEP

SLTYRLLKDKSSSKIACRFIVDASGQNAVIAKQLGIRTIDADFRFMSLWGYFKNSKYIGLDGKAHSVENL

RTILPTTFICSFAETGNWGWSWHIPLRESTSVGLVLPLEFMKKVQLNGGSWESYFRQKCYEIPILEDLLA

NAQFCEGSFAKIQDYSYRSTQLAGPGFFLIGDAAGFIDPIFSLGIVLGIELLQNNFMVLW

44) Dsg47 Dsg47 from *Trichoderma gamsii* PNP44317.1
MAIPEKCTVLVVGGGPAGSYAASALAREGIDTVILEADKFPRYHIGESMLASMRHFLRFIDVDSEFDNYG

FTKKVGAAFKLNPRKREGYTDFLAAGGPENYAWNVVRSEADHLLFKHAAKSGAKAFDGVQIKKINFVDAP

YKGSGELPHEYPGRPVSASYLRKDDNTTHEIKFDYIVDASGRVGLLSTKHLKNRRYNQGLKNVANWGYWK

GAGAYGKGTPRENSPFFEALQDESGWAWLIPLHNGTVSVGVVMNQKMSAERKSQMGSPDSKTFYLNCLKE

LAPDLSNLMENGELITDIKSASDYSYSASGYAIPYARIAGDAGCFIDPYFSSGVHLAFVGGLSAATTIAA

SIRGDCSEEDAADWHSKKVADSYVRFLLVVLSAYRQIRAQNEPVLSDFDEDNFDRAFAFFRPVIQGTADV

DSKLSQAELSKTLEFCSNAFEPVKPEDRSSMLEKLGQNPDTAYQVDLSPQQRTVVDHIRARQMMRTEDTM

NINSFGTDAINGFIPNLKKGGLGLVRA

45) Dsg48 from *Halobellus rufus* WP_049984930.1
MAGSTISMILAKNDLDVLLIEAKKHPRFAIGEAMLPLSAVWMWIVGEYFDVPEIQHLSDANRIVDNVTES

CGVKHSVGFAYHERGQPFSGEHAHQLVPPEMPFYKESHLLREHVDHYLVESAGSYGVEYVDETPITDVEI

DDDEVTVTTDRGTTTGAVFVDATGGNSILAEKRGYRDETPDLETDTRAIFAHVEGLEPFDELIDEEDRPG

QTNRLHDGTLHHVFEGGWLWVIPFDNFDRSTETKASVGLMLDRNTRPRDESLSAEEEFHEIISAYPDVER

HLGPVEPVMPWIRTGRLQRSASESSGHRHLLTNHTYGFVDPLYSQGMVHTFESVFQSAKLLLEAFEVGDF

SAERFAPIDDLHRRQLETADLLVSNAYTSMDEFDLWNAWTQLILVESVFPDLYIQRHCLKYLSSGDPAEL

DRLLRETRPGDDAPFAPEKDALLDRSSAVLDAYTAGEISAGTAAESLFDAMKRADWLPRSVYDWGNEDER

HIDFADPAVTGELLAWGRTDAPAHIREGLFDFEMPEMP

46) Dsg49 from *Diploscapter pachys* GenBank: PAV66111.1
MTPPPSSIAILGGGTAGWMAACLMAKAWPQARITVIESPDIGIVGVGEGSTPQLKALFDALGLAEADWMP

AADATYKAGIAFHGWSDDTPAYFHPFAGQIDLHTQGAFFASTRARRHGADVPAHPDRFFLNARLAEAGRA

PIAPAHFPFRIGYGYHFDAHKVGHVLRDAAVARGVVHLPRRVHDVVVDTAGQVVALTLDEGDALHAELFV

DASGFASAIAQQALGVPFRSFANTLFADRAVVMPTPRQAALPVQTKATALSAGWAWGIPLTSRTGNGYVY

ASRYLSSDAAETELRRHLGLLDADVAARHLSMKVGRVETSWTANCLAIGLAQGFIEPLEATALHIVQATI

-continued

EGFIGAYQAGSRDAFNAAIARRYDGIRDYIVAHYRLNRRSGPFWRDVAANDDLSDDLKAIMTAWFTGGDV

AAVVEGRGLAGYYAPMSWEVLLAGYGTFPDATRLRTAPPVADLAAIDTLLSGCLLNFPDHQAALDGHRRM

P

47) Dsg50 from *Ricinus communis* GenBank: EEF25242.1
FAPRDHNAAPGSPLADIAYAYHFDATLYARYLRELAERRGVQRIEGKIVGVQQRADDGHIASVTLESGQV

VDGELFIDCSGFRGLLIEQTLKTGYVEWSHWLPCDSALAVPSASVDPVTPYTRASAQRAGWQWRIPLQHR

TGNGYVYSSKYISDDEAAATLLANLDSEALAEPRQLRFTTGMRRKFWHKNVVALGLASGFLEPLESTSIY

LAQSGITRLLSMFPQRDVHPLLVERYNQESAFEYERVRDFLILHYHATERNDTPFWDYCRTMAIPDSLRE

ATDLFRSDGRYFRNGDDFFALPSWVQVMLGQGIVPRGYHPIVDEMPESVLIEQVGGMERMLADAVAAMPT

HQEWINRYWKAPAL

48) Dsg51 from *Fomitiporia mediterranea* MF3/22 GenBank: XP_007270069.1
MPSEIPGTCTVLVIGGGPAGAFAAAALAREGIDVILLEADNFPRYHIGESMLPAMRHMFRFIDVDSAFDS

FGFIIKNGAAFKLNQHNREGYTDFVAAGGPNNYSWNVLRSESDNILFRHAAASGAKVFDGVKVTELSFKP

DDASHLGRPIRASYVFKSNRETGDIAFDYIVDATGRAGLMCTKYLKNRTYNQSLKNIAMWAYWKGTGVYG

IGTPREGAPLAEALIDESGWAWFIPLHIGTSVGIVMDQELTNKKKRAHDPPLSGLEFYLEQLRLAPTIMS

LLGSANPTNIDDEQMVRSASDYSYSSSCYSGPGFRIAGDAGAFIDPFFSSGVHLALIGGLTAALTICASI

RGDCTESEAADWHSKKIGSSFTWFLMVVLGAYKQMKSQRDAVLTDINEDNFDRAFSFIRPIIQGSIDVDE

QLSVSDLSKVIDICVRAFEPAQTESREAVLAKLKDECFATQVYENSQYLCIGNVGENVLSDDEKRVLAYI

NAREVLGARDRALTMNAFVTDVIGGRRPRLKQGELGLEIATNRMS

49) Dsg52 from *Dyella thiooxydans* GenBank: AND70239.1
MAQRPEFPAGLRPFFAIGQVSEDDGTAAGEEPAMARINKVLVVGGGTAGWLVACYLARAMRSSDPSGIQV

HLVEAENIGLLGVGEATFPSIRGTLAAIGLDERHFLDGAHATYKQGIHYRHWVRPPGTPGRDAFFHPFNQ

PSQRPGGPELLPYWLLGEAPAELPFAEAVTLQSRVVEGGRAPKRPQDPDYQGPLNHAFHFDAACFARVLA

EHGTQTLGVHRHVATVERAELDERGAIARLITTELGPMTADLYVDCTGLRSHLAGGTMQSPFLSRADVLF

ADRAMAMQVPYDRPDAPIPSYTIATAHEAGWTWDIGLQQRRGVGYVYSSRHTDDARAEQVLRGYLGNAAE

GLTPLRIRFETGYRPEHWRHNCVAVGLAGGFVEPLESTGIALVELGAYLLTHALPADLDDLPRIARHYNT

MMVARYERIIDFIKLHYCLSQRRDTPFWRDNTAPGSIPQTLQDKLALWRYRPPHRLDFVGDLEMFLVASW

QYVLYGMEFRTDLTPMRRSYTQVAEARQEFATIQQVAARAQDDLPDHRAFVERMVREHRERAGRAHAAA

50) Dsg53 from *Sphingomonas parapaucimobilis* NBRC15100 GenBank:
GAM02388.1
MTNDVVRVVIVGGGTAGWMAGAALTRLLSGQCSVRLIESEAIGVVGVGEATLPHIRSFNERLGIPEAEFM

ARTRATFKLGIEFRDWSRIGDSYIHPFGTFGRGTGAIDFHHYWSRLVREGRDLPPLDQLSYACTLAREAR

FEHPDQGRGGLSSTFGYAYQFDALLFAPYLRSLAEEAGAIRTEGLVVDVERDSQNGLIRAVVLDSGERVE

GDLFIDCSGFRSLLLGQTLDEPFEDWSKWLPTDRAVAMPCRTETAVTPYTSAIAMPAGWRWRIPLQHRTG

NGYVYASDFVSDADAAHALEKAVEGEKLAEPRLLRFKAGRRRRSWVGNCVAIGLASGFLEPLESTSIYLV

QQAITALIELFPGRRMEASDRDEFNRVIDLEYDRIRDFLILHYHATSRDDSPFWNYVRTMPIPDSLGEKL

ELWRRRGRVVKYREGVFLDASWIAVYLGQGIVPEGWDPRADVAGTGDLVQAVAALRSEIAAEVAIRPDHR

AFLERYCPMVAA

51) Dsg54 from *Aspergillus arachidicola* GenBank: PIG8503.1
MTNVPEKCQVLVIGGGPAGSYSASALAREGIDVVLLEAEKFPRYHIGESMLPSMRHFLKFIDAYDKWDAH

GFNVKNGGAFRLNWSRPETYTDFISAGGPGGYAWNVIRSEADELLFKHAAECGVKTFDETKVASIEFAPS

EDANPLGRPVSATWNRKDGTSGTVAMDYIVDASGRNGLISTKYLKNRTFNKGLRNVASWGYWKGGGVHGV

GTHKEGAPYFEALKDASGWVWFIPLHNGTHSVGVVQNQEMATEKKRKMAEPSSKGFYLESLEFVPGIKEL

-continued

LSNAELISEVKSASDWSYSASSYAFPGVRIAGDAGSFIDPFFSSGVHLALSGGLSAATTIAAAIRGDCDE

TVAASWHDKKTSESYTRFLLVVSSALKQIRSQDEPVISDFDEQSFERAFDLFRPIIQGQADADAKGKLTQ

AEMSKTVEFCFRAFAHVSFEEKEALVKKLKSLGHDGDAYDEANRKALDELEKHLTPEEQAILKTLKGRRM

VRPEDSLNIDNFTLDSIDGLAPRLEKGNLGLSPAKKAEVKFTTHDALSFLNGEARAAKKTLSDGQSQTNG

NHMCKDHDQTNGHTETNGHIESNGNAATNGHTEANGQSHANGHTNGNHMTNGHDEVNGHNNVEVRTVKSC

MADLIAAEKSSFQTPVEEATRHRLISSLHQSAEDLETPFDTVVRLVDAGRQTAMVCIGGDLGIFKSLVES

KRPLSSEELAKATMADPLLVSRIMRYMVASRLVGETGPDQYVASKKTYVFADPRIEHPIRFFHAFSNPAF

HALPEFLKETGYQNEPKGSAFQKALSTDLEPYPWLKQHPEVLKNFQAAMRLTRDANGVDMMPLDESVSSG

HDGAMFVDIGGNTGHQAAEVLSKYPELAGRVVVQDRGEVIKCAPDIKGIQWMEHDFFQTQPVKGAKYYYL

RAILHNWDDKNTVQILSNIVPAMSADSLVAIDEVVVPEENAHVWPAGLDLQMYSLFSTTERTASQWDTIL

DKAGLRAVAVKKYAPVMQSSVIFAAAK

52) Dsg55 from *Albimonas pacifica* GenBank: WP_092860541.1
MTAMSGGPDPLRVLVAGGGSAGWMAAATLDAALNRGGARAVAITVVESPDTPRIGVGEATIPTIRRTLRR

LRIPEAEFLAAAEATFKQAIVFADWSGPGSGFAHPFHTRPGDGAEQAAARFLRSDGRTPFADLVTPQPAL

AAAFRGPRRAGDADYVGPLPYAYHMDAEAFAELLAARAVTRGVARVSAHLRPPERAPDRPLEAVEATDGR

RFAADLFVDATGFRRLLIGQGGFLDQSRHLICDAAVALRAPCAPGPTRPFTVAAAREGGWTWDIPLRTRR

GRGYVHATAHLAPEAAEDALRAETPGAGEARRLRFQVGRLAQPWQANVVAVGLAAGFVEPLESTGLHLAD

LAAGLLAENAPLAGPNPGLARAYNALLAAAHDEVVDFVNLHYAASPRRDTPFWRDAADPARRTDRVAHLL

ELWEARPPVAADFPSSLQAFNHRNWEFILHGLGWRPRALGPAGGPPLAPDPELAAEARRLAAELPGHDAL

LAALAPR

53) Dsg56 from *Cylindrospermum stagnate* WP_085960655.1
MHVEKTIHNVVVLGGGSAGFLSALALKVKMPSLNVVVVHSKTIPVIGVGEATTAWIPWFLHTYLGLNRQQ

FYEETQPIWKLGIKFIWGNSHQSHFNYPFVTHLADKLSVLDKSTAYYCLDSTRESSIYSLLMEQYKSPCF

RKENGDFVFDERFGYHIENASFVSYLERRAAELDIKIIDQPVVNIQVAENGYIHQLKLDDGTTLAGDLFV

DCSGFRSTLLGEILQEPFCSFSSSLFNDSAVTGTWMRDDVIYPFTTAETMQAGWCWRIDLPEQVNRGYVY

SSAFISDDDALAEMKRQNPLMGDDHHSVVRFKSGRHQRFWVNNVVGVGNASGFVEPLESTGLHMIGETIK

CVCDVLIDSDQQPTPGLINLANQAIAEKWDDIRDFLSIHFKFNRRVTSDFWQHCWQQTDIGEAEAVVDFF

QNNGPSPIGQLLLRKNSVFKYNGYLNLLMGQQVATKYQGNNEILDLDNWRQVKNYFLKNCDNALPIHEAT

QVVKERKCQWLSS

54) Dsg57 from *Actinocynnema* sp. ALI-1.44 GenBank: ONI77922.1
MDHKELAAGMGAGHRTELHAVLESLGESEAAAVRSWLGGGETPDPLALLGELAPVPSDLSRPDDADPQAI

RRIGVIGGGTAGYLTALALKAKRPWLDVTLVESRQIPIIGVGEATVSYLTLFLHHYLDIDAEELYRCVQP

TWKLGIRFDWGPHPDGFMGPFDWSADSVGLLGALAATGNINGSTLGSAMMVADRTAVFDVDGRPVSLMKY

LPFAYHLDNGRFVSFLTDLARRRGVHHVEATLADVVVSGAEWVDHVRTDDGRELRFDMYVDCTGFRSRLL

GQALGTPFTSFASSLFTDSAVTGNIDHGGHLRPYTQATTMNAGWCWRIPTRESDHRGYVYSSAAISDQEA

ADEFARRYPGVDGLRQVRFRSGRHEKSWRGNVMGIGNAYGFVEPLESTGLLMIAVAVHSLVSTLPGSWSE

PSPRELVNAGLGQQWNAIRWLLAIHYRFNTRLDTPFWKEVRATADVSGFDTLLEVYAGGAPLSQRHVLVQ

DVLNRIAPTFFGLFGIDYLLLGQQVPTRRMPLAEPIERWHARKHAADALVAAALPHREALDAFDAHPELN

KQLLEDTDSWAGRSIAKRVGLL

55) Dsg58 from *Trichophyton violaceuym* OAL70258.1
MVGLVAIISVWWCVRPKPNKIPIIGDAKNQNFMAALEEGSRKQYPESCFRIPTRDIPTIIVPRKCLSTIA

YAPEHRLSLGREVYERLMGRYTKMVKSDHLAEFVRGGLSKQLGANISLLQEDAIWTISSQIGNCPEWKPL

QLFPAMVKLVPLHIGRTFINSPLSREQEWIDLTLEYAISTVTIAAKMSNTHWMLRPFKALFLPEIGEMSQ

-continued

QFKQASKLLSPVLNARLLGDAPGTKDLMQWMIDNYPGQSNNLTLHTRLQLEAVQAATYNLAFQLIHFFFD

ILAHPEYIEPLRIEIQTVFDSCGRTWTPAALAELRKCDSFLKESQRLNPIGIVSVSRFALSKFDLPDGTT

VPAGISVSAPAMTVNTDPSLWECPTQFDGYRFEKLRQIKGNEYKYQFSSISASELNWGYGTHSCPGRHFA

SNQVKVIIAELLMKYDFRFEENIQDNQTPKRPANNFDGVRIMPNPEARIMIRSREVGAICSVPEERDRGK

GDRIYRASNHSRVNGTNKSFNFTEEANMSIPASCTALVVGGGPAGSYAASALVREGVDVVLLEADVFPRY

HIGESMLPSIRHFLRFIDLDSKFDSYGFVQKNGAAFKLNSKPEAYTDFVAAGGPGSYAWNVIRSEADHLI

FKHAGENGAKTFDGVKVNAINFEPLSEENSDPVSTDLGRPVSATWTRKADKSSGVIKFEYLVDATGRAGL

VSTKYMKNRTYNQGLKNVATWGYWKGASSYGIGTPREGDPYFEAIADGSGWVWLIPLHDGTTSIGVVMNQ

AMATTKKREAGSSSQQFYLDNVKQIPGIWQLLDNAELVSDLKSASDWSYSASSYASPYLRIAGDAGCFID

PFFSSGVHLAFASGLSAALSIRAAQRGDCDEMAAAEWHSKKVAEGYTRFLLVVMSALKQISDRDEPVLTD

WDEESFNRAFDLFRPIIQGTVDVDKTLTQAEIAQTINFCVNAFQNAGREEQDALMNKIKSVSETKNGEET

DVVKKLKESLSADERRTLNTIQARQIIRSEDTMNIDNFTVDVIDGMVPNLKRGSLGLLRYVPKVKAGQQE

DELRAKLGLPEKQESIFSY

56) Dsg59 from *Piloderma croceum* F1598 GenBank: KIM79851.1
MSRSAVPKKAQILVLGGGPAGSYTACMLALEGFDVVLLEAAKFPRYHIGESMLPSCPQFLKLIDLEETVE

NFGFCNKPGAALKLVGEKKEAYTDFIRTHPENRSWNVTRADFDEILLRHAEKVGVKVFEETRAFSIKFVN

DNPKGRPLAVKWQNIIDRNVSGTVSFEYLVDATGRDGIMAQKYLKHRKVNTSLRNVACWGYWKGAGVYGV

GTSRENAPWFEAHTEESGWNWFIPLHNGMTSVGVVINEDAGNQRKLAAKRANGGVASTLKRHYLDCLQLS

PGLIDLLGDAKLLEDGPYPVVQSASDFSYNAPTYSGDHYRLIGDAAAFIDPFFSSGVHLALTGGLAAAVS

IASSIRGEYSETEGCKYHDAKIGVAYTRFLVVVLSAYKQMRAQNRSVLSDFDEDNFDRAFDIIRPVIQGD

ADVGRRMSEDELQKLIALCGSALLPVDPEVYARVVSRLDTKLVDPRGAIVTPEEIDLLVPNDLEARLVLK

EINARKSTGGLFLTISDSFEEVTAGFSARVHRGNIGLISHAPKANSTSGFSIQVGKARPSHLPHLLLLFF

GVVLALLFHQYGTFGVV

58) Dsg60 from *Cellulophaga* sp. W5C WP_077399145.1
MTIHFIEYEESKICQSIIKQLQEKYNFSCCLTKDLGCVKNNDLIIWFVQNENLESVLNTCANIRKHLPDT

TILFVSAFECDKILIGPIYSPNNTSGLDSALFFLYQEKCEDINSKLKLKLPLFKDILGEEFYIKRIHKLT

QKLAEKINEFKNVSQNKNSINKIEIYNIKESNFDERFVYPILEIKEDFYEKKKNSQLIQDINFINASKKD

FRFKLLNKSTLNKTVAIVGGGTAGYLSAISLKTKHPELEVTLIESEKIPIIGVGEATTPDLVDFLFKDLK

LDKLDFYKKVEPTWKLGIKFYWGESGDYTFNYPFGEHDLVSGYINGNIDHGSLTSILMSQDSSFILRKNE

KDFYSLTNPRRIGYAFHLENRKFVTYLKNKAIELGVVRLQNTIDKVILNDSHNQVSSLITSDGKKLQCDY

YLDCSGFKSLLIDKLDSQYFSYNDNLITDTAISFNVNHKGEIKPYTYAESMKNGWCWNIPLRDSDHRGYV

YSSKLSSENDIIDELKLKYPNLTDYKVIRFKSGRHNSFIKGNVAAIGNSYGFVEPLESTGIHMITEHIKI

LTKSFDALINDRTGTLKGHLNRHIANKWDYLKWFLSIHYKYNKKFDSPFWEFCRNEIDVSKYQHILDLYK

SDGPLQMLNNSLSDSLRFDFVDSLFGLKGVDNILLGQGVIPNSIDDIQNVGHELWKYNVNTWMNLSKRTI

PLKEDIEILVQNPNLI

59) Dsg61 from *Hydnomerulius pinastri* MD-312 GenBank: KIJ65857.1
MSATIPTHTQVLVIGGGPAGSYAASALASEGLQVVILEGAEFPRYHIGESLIPSVRHYLRYIGAEQKLAD

HGFKHKPGAAIKFNQFKREGYTDFVALGHSNNSWNVTRSDFDKMLLDHARESGAWVHEKTKVQSVRFSSS

EPSRPVAAEWSQSSGTGQEGVISFDFLVDATGRTGLMSNKYLENRHYNESLRNIALWGYWKGVGTYGGGT

TREGAPWFEALTDDSGWAWSIPLHDGTTSIGVVMNQKLYNERTKALPGSSTATRYQSFLSLAPHVFNLIG

DGVLVAKPSVDGPPGSLDPLVRSASDFSYSAPEYGGNSFRIIGDAGAFIDPLFSSGVHLAMTSALSAAAS

ICASVRGDCSEDVASAWHSRRFSLSYTRFQMVVLSAYKQIWATNLDVLNDVDEDDYDRAFASIRPVIQGA

-continued

SDMGTRLSEGELQNALEFCSKFFNPTSQERRGYYTLKHGLPKELFDITAPLVDPKNMDAALRSAGINLSE

DGGSAQEDEVKLVMEQVNARRVLHREYAVNNLEAEEINGYAVRLERGSLGLVKVV

60) Dsg62 from *Trichophyton soudanense* CBS 452.61 EZF74478.1
MSIPASCTALVVGGGPAGSYAASALVREGVDVVLLEADVFPRYHIGESMLPSIRHFLRFIDLDSKFDSYG

FVQKNGAAFKLNSKPEAYTDFIAAGGPGSYAWNVIRSEADHLIFKHAGENGAKTLDGVKVNAINFEPLSE

ENSDPVSTDLGRPVSATWTRKADKSSGVIKFEYLVDATGRAGLVSTKYMKNRTYNQGLKNVAIWGYWKGA

SSYGIGTPREGDPYFEAIADGSGWVWLIPLHDGTTSIGVVMNQAMATTKKREAGSSSQQFYLDNVKQIPG

IWQLLDNAELVSDLKSASDWSYSASSYASPYLRIAGDAGCFIDPFFSSGVHLAFASGLSAALSIRAAQRG

DCDEMAAAEWHSKKVAEGYTRFLLVVMSALKQISDRDEPVLTDWDEESFNRAFDLFRPIIQGTVDVDKTL

TQAEIAQTINFCVNAFQNAGREEQDALMNKIKSVSETKNGEETDVVKKLKESLSADERRTLNTIQARQII

RSEDTMNIDNFTVDVIDGMVPNLKRGSLGLLRYVPKVKAGQQEDELRAKLGLPEKQESIFSY

61) Dsg63 from *Talaromyces cellulolyticus* AMD-G3 GenBank: GAM38376.1
MSIPTKTTVLVIGGGPGGSYTASALAREGIDTVLLEADVFPRYHVGESMVASIRHFLRFIDLDTTFNNHG

FIKKTGAAFKLNNQKTAYTDFIVAAGPDSYAWNVIRSEADDLIFRHAGKSGAKIFDGVKVTSLEFVPNKE

ADLPTDGTADPGRPVSATWTAKDGRTGSISFDYLVDASGRVGIVTTKYLKTRSYNQDLKNVASWGYWRGA

ISYGVGTPKEGQPFFEALQDGSGWVWFIPLHDGTVSVGVVMNQEMSTQKKKESTTDNGRDFYIESIKDAH

GVTHLLQNAKLDTEVKHASDWSYSASEYASPYVRVVGDAGCFIDPYFSSGVHLAFSGALSAAVSISASIR

GHCDETQAWKWHSTGVRDRFTRFLLVVMSATKQIRARDAPIMNNQGEDGFDDAFTIIRPVIQGISDVTGK

TTHDEVSRAVDFTTEAVAKTKPDDSANSSSQAGPQFTDTIQQGSLTKDEAKVLHMVKNVFKDFFVADVYN

GYRAKLERGSLGLEKVNTEALLVGEKLSGTKTEVKEVEV

62) Dsg64 from *Moniliophthora roreri* KTB28644.1
MPTGCSNSSPPRSIDILVIGEKLTIPQLSPGGPAGSYAASVLAQEGLNVALCEASKFPRYHIGESLLPSV

RNFLRFVGAEGKVAKHGFTRKPGGAIKFNHQKREAYTDFVAIGQENSSWNVVRSEFDELLLNHARSCGVS

VFEQTKITSLTFAQEDPSRPVSASWISSESSGEHDGAPGERSGTICFKYLIDASGRAGIMSTKYLKNRHF

NQSLKNIAVWGYWTGVSSYGLGTPRAGAPYFEALNDESGWAWFIPINNGTTSVGIVRNQQMHVEQLRCPV

SGEIPFDGSAVPNPSQSRMVDQYAFNLSLAPGVVKLITEHGKLEEGSVKSATDFSYSASVYGGNGYRIVG

DAGAFIDPFFSSGVHLALTSALSAATSICASIRGDCSEEEAAVWHTRRFSTSYTRFQIVVLSAYKQLRSQ

QLNILSDIDEDNFDRAFNFLRPVIQGNGDMGVRLHGRELEDCLDFCVKLFNPTDPEEHDRLRNDKNFDKA

LLDLSAPISNLSAITPGSAEAKEILEKVNSRKVLNAEYTTDSFVSESLGGYSVRFEKGALGLKKGA

63) Dsg65 from *Nostoc calcicola* WP_073644584.1
MEKTIHNVVVFGGGSAGFLSALALKVKMPALNVVVVHSTTIPIIGVGEATTAWIPWFLHKYLELNREQFY

EETQPIWKLGIKFIWGDSSQSHFNYPFVTHLADKLSVLSKSTAYYCLDSTTESSLYSLLMEQCKSPCFRR

ENGDFVVDERFGYHIENVSFVSYLERRATEIDIKIIDRPVVNIEVAENGYIRQLKFDDGTMLAGDLFVDC

SGFRSALLGEILQEPFCSFASSLFCDSAVTGTWMRDDAINPFTTAQTMQSGWCWQIDLPDKVNRGYVYSS

AFINDDDALQEMKRHNPLMSDRHSIVRFKSGRHQRFWVNNVVAVGNASGFVEPLESTGLHMIGETIKCVC

DVLIDSDQQPTPALINLANRAIAQKWDDIRDFLSIHFKFNHRVESEFWQHCWHQTDIGDAEAIVDFFQSN

GPSSLGQILLRPNSVFGYNGYLNLLMGQQVATKYQSHNDILDLDRWRQIQNYFTKQCANALSIHEAIQVV

KERKCQWLTS

64) Dsg66 from *Massilia* sp. Root335 GenBank: KQV33239.1
MSYQSIAIVGGGTAGWLAACYLQRALNGNPAHPVRITLIESPDVAAIGVGEATVPTLRMMLRTIGIPEAA

LFASAEATLKNGIRFVGWHDGTDSFDHPFDMPIVADGYSTMTHWLNLKQRGLTRQPFGEAGVVQPALMDA

LRSPKLMSSAPYEAPVPYAYHLDAVLLARLLRDTAKERGVVHVEGTVEQVDVDETGIRAVCLADGTRHAA

DLFVDCTGFASLLLGKTLDVPFHSYADTLLCDRALACPVAHEASDAPLRSHTVATAQDAGWTWDIELQTR

-continued

KGTGYVYSSRHCSDDEALATLRRYNAGRTELAEPRLLRMRVGRHTRMWEKNCLALGLAGGFIEPLESTGI

YLIEYALQMWLDYLPTPAGAAPMRDRYNMLMAEHYDELHDFVLAHYVLSARRDTAFWRACTEEVKVSDRL

AALLALWKHKLPGTADIDARRQVLFGPHNWFFILAGQRCLPEHGIGQMPYIAPERSQAALARIAEIRKAA

VSQSPSMREYAQKIRAAAANAPRR

65) Dsg67 from *Candidatus Thiomargarita nelsonii* GenBank: KHD12528.1
MNSINNIVIVGGGTAGWTTAACLARVLKNTDTKITLIDSPEVATIGVGEATIPPLVEFIRFLGINEQEFV

TKTQATFKLAIKFTDWNNLGEHYWHQFGSVGADIDGKPFYQHWFKSTLNGNENAYTDYSPAIAMAKENKF

VVPPTQQQQQSILNGASYAWHFDALLVANFLTEFSTNLGVKHLKGHVECIEKHENGFIKNLILKDGRNIN

GDFFIDCTGQKALLIEGAMGSEFENWQKYLPMNRTIALQTENHGPLVPYTESTAHKWGWQWRIPLQHRTG

NGMVFCDKYCSDDEALATLTNNISGKHLTEPKFISFTTGKRKELWKGNCLALGLSTGFMEPLESTAIHLM

MKGVIKFAEMLPDQRCQQATINEYNRIMDIEFLSIRDFIILHYCTTSRTDSKFWQDCQNMPIPASLVEKL

ALFKSQGRLFRSEFDLFTPPSWYAILAGMNIKPDNYDRLIDISDINQVNSIMTNGLTSLNNTIIQLPSHE

AFVKQFCKNI

66) Dsg68 from *Penicillium nalgiovense* OQE91609.1
MAAIQTVPEQCTVLVVGGGPAGSYASSALAREGISVVLLEADNFPRYHIGESMLPSMRHFLKFIDCYEKF

DAHGFRVKNGGAFRLNWSRPESYTDFIAAGGPGGYSWNVIRSEADEILFRHAGESGASIFDGTKVTGIEF

EESSEDVVDSANPNPGKPVSATWSRKDGSTGLVKFDYLIDASGRAGLVSTKYLKNRRYNQGLKNVASWAY

WTGGGTYGVGTHKVGAPVIRTDASGWVWFIPLHNGTHSVGIVMNQAKATERKKAMDSPSSKEFYLENLNL

VPGIQALLEKGELVSEVKSASDWSYSASSYAFPHVRIAGDAGCFIDPFFSSGVHLALSSGLTAAVTISAA

IRGDVTEKEAAQWHSSKVAEGYTRFLLVVLSSLKQIRGGDEPVLNDWDEESFDRAFDHFRPIIQGTADAD

SEKKLSTEEISKTIDFCFRAFAHVPVERKDALLEKMKNHGVSDPTATDPKTREALEELKNTLSPEELDIM

NTIRGRRMIRAEDSLNIDNYRLDSINGMAPNLERGNLTLRKAEINKIDVSKKDLLSLLSGEAAEGKHHET

EETKAPAAAVAEVAEFAT

67) Dsg69 from *Sphaerobolus stellatus* SS14 GenBank: KIJ54121.1
MSNGVPSVPEKTTVLVIGGGPAGSYSSTLLAREGIDVVLLEASKHPREHVGESMLPSMRHYLRFVDLEEE

YDRRKFMHKPGAAFKFVHGQRECYTDFSILGPDRTTWNVFRAEADEIMIRHAEKRGVKVFEQTRVESISF

ENDGDPATARPIAAAWKNKSGETGTIKFDWLIDASGRQGIMSTKYLKNRIYREGLRNVAAYGYWQNVSVF

DEGGPRSNAPWFECLTDRYGWAWCIPLHNGKTSIGVVMHQETSNKKKAEGPSGLEAHYMEQLKLAPGIQE

LIGEKGTFVPGTVRSTADYSYHATSYSGDHYRLIGDAAAFVDPLFSSGVHIAMTGALSAAGTILGSLKGA

VSELEAQNWHDAKIGICQTRFLMVVLSAYRQMQHQGNKAILGDVNADNFEHAFEIFRPIYQGEQDTSTKL

TDDELEKMIEFTRNLFTPTTHQQYASVKQRHGDMLDLSAPVVSPGELDKVLDTEDSDAKAVLKRINSLKI

LRNETSPLSFTSEAVNGYILRLERGNLGLVKA

68) Dsg70 from *Panaeolus cyanescens* GenBank: PPQ70820.1
MSTEGPIPTKTNILVIGGGPAGSSAATILRREGHEVTLLEMAKFPRYHVGESMLPSLRNYLKFLGVEEDF

VKHGFLDKPGACFKLVPNLRESWTDFTALGPGYATWNVVRSEMDEILLRHSAKEGVKVFEETKVDSIQFE

GDPKTSRPISANWSKKDGTSGNITFDWLIDASGRNGIMSTKYLENRQMRENLRNVAVWGYWKDVNRYGVG

TKKANSAWFEALRDETGWSWIIPLHNGTTSVGFVMHITNSNKKKARLNPDGTKMSLTDHYLDQLQYAPGV

RELIGEKGSFIPGSTKSTSDFSYSATRYSGDHFRLIGDAANFVDPFFSSGVHIGMTGALSAAATICASIK

GEADETTAQAWHDAKVGIAHTRFLFVVLGAYRQMHLQSTPLLGEVHEESFDKAFEMFRPVIFGLADSQKK

LTDAKVNDVMDICQSFFDPTVDEDHIHATRQRYGVDLVKMQAPVLGKDKIQELVKDDEVGERVLKKFDAL

KVFSDDVEATYMGRNPLLGYRANVKRGELGLIKADEEDPLEKDILVAAP

-continued

69) Dsg71 from *Asticaccaulis* sp. AC466 GenBank: ESQ85030.1
MFLTCRRRLLDGAGFFLRLDTAMTTPKSGHRDAFFVLNGIEMTTTGPLRKIVIVGGGTAGWMVANALSKV

LGKSGPAITLIESEEIGTVGVGEATIPPILAFNALLGINEVEFMKETQATFKLGIEFVDWLRIGHRYFHP

FGIYGVDAGAVPFEALWQRSRHLGTPRPLNDFSVCARAAAMGRFMRPAGAGGPLAHLAYAYHFDATLYAR

FLRKYAEAAGVTRIEGRIAHTSQRPDDGFIEAVTTQDGRRIEADFFIDCSGFHALLIGGVMGAKFEDWNH

WLPNDRAVAAPSANMAPPTPFTTSTSRTAGWQWRIPLQHRTGNGYVYSSAHSSDQAAQDLLTTNIAGDLL

AEPRVIKFRTGRQRAFWIKNCLALGLASGFMEPLESTSIHLVQAGIARLLEMLPNRSCDPADIRRYNRLM

TTEYDSIRDFIILHFHATERRDTQYWRSLANMSIPDTLAERIDIYRHSGRVFRESDDLFSKTSWLAVMDG

QGLVPQAYDPLAEGVSPEQAQKHMEHIASVQAAAVKTMPSHHNYIAKYCSTAQ

70) Dsg72 from *Stachybotrys chlorohalonata* KFA69541.1
MSIPDSCAVLVVGGGPGGSYAASALAREGVNVVVLEADHFPRYHIGESMLASIRHFLRFIDLEKTFDSYG

FCKKVGAAFKLNNKREGYTDFIAANGPNGYSWNVIRSEADKLMFEHAEKSGAFTFQGVKVESLQFVPDDG

VAKDDTVCNPGRAISASWLRKEDGVTGNIKFDYIIDASGRNGIISTQYLKNRKFNQALKNVANWGYWKGA

TTYSPGTPREGSPVFEALTDQSGWCWAIPLHDNTLSVGVVMRQDLSLARKKSLGSPSMVEFYKDCITLSP

DIHARLADAELVSNIKAASDWSYSASTYAGSNFRLVGDAGCFIDPYFSSGVHLALASALSAALTIQAARR

GDCNELDAAKWHSAKVAESYSRFLLVVMTALKQIRKGDEPVLSDFDEDGFDRAFGFFKPIIQGLADADVG

GKLTQGLISKSVDFCFHAFQDITPNVRQAVLDKLDSMKSDPSVETKEDLEKLSEDELTILRTIRARQMLR

TEDTMNITSFANDVIEGYAPRLVCGSLGLSGMESRMAAPSNAETLFDSGIEILDENKS

71) Dsg73 from *Verruconis gallopava* XP_016211617.1
MTTIPEKATVLVIGGGPGGSYAATALAREGVDVVLLEADKFPRYHIGESMLASMRHFLRFIDLDSTFDNH

GFIKKRGAAFKLNDKPEGFTDFIAAGGPGNYAWNVIRSEADYLMFQHAGKSGVKTFDQVAVRSLEFTPCD

LELPDPKTPSPGRAVAACWSSKVDGTSGKISFDYLVDASGRFGITSTKYLKNRKFNQGLKNIANWSYWKN

AGRYAVGTQREGQPFFEALSDASGWCWLIPLHDGTASVGIVQNQDAAAAKKKAMDSPSQHDFYIESLKLA

PRIQALLAQGEMTAPVKQASDWSYSASCYASPNVRIVGDAGCFIDPYFSSGVHLALSGAMSAACTIRAVQ

REECDEKAAMDWHSKKVAEGYTRFLLVVLSAMRQIRKSDQPILSDWDEEGFDRAFAFFRPIIQGTADVSN

KLSQEELAKTIDFCLNAFQHHDADARDAMIKKLQEHEQEARMRGDVQAKADIDPDSLTPEELQVLKTIRA

RQMLRTEDVINIDSFGTDAIDGFAPRVKHGELGLMKGKNSGPAAPKMDLFAKAKEEPAMQTQVGTAVTAH

72) Dsg74 from *Trichophyton rubrum* CBS 735.88 GenBank: EZG06870.1
MSIPASCTALVVGGGPAGSYAASALVREGVDVVLLEADVFPRYHIGESMLPSIRHFLRFIDLDSKFDSYG

FVQKNGAAFKLNSKPEAYTDFVAAGGPGSYAWNVIRSEADHLIFKHAGENGAKTFDGVKVNAINFEPLSE

ENSDPVSTDLGRPVSATWTRKADKSSGVIKFEYLVDATGRAGLVSTKYMKNRTYNQGLKNVATWGYWKGA

SSYGIGTPREGDPYFEAIADGSGWVWLIPLHDGTTSIGVVMNQAMATTKKREAGSSSQQFYLDNVKQIPG

IWQLLDNAELVSDLKSASDWSYSASSYASPYLRIAGDAGCFIDPFFSSGVHLAFASGLSAALSIRAAQRG

DCDEMAAAEWHSKKVAEGYTRFLLVVMSALKQISDRDEPVLTDWDEESFNRAFDLFRPIIQGTVDVDKTL

TQAEIAQTINFCVNAFQNAGREEQDALMNKIKSVSETKNGEETDVVKKLKESLSADERRTLNTIQARQII

RSEDTMNIDNFTVDVIDGMVPNLKRGSLGLLRYVPKVKAGQQEDELRAKLGLPEKQESIFSY

73) Dsg75 from *Penicillium nalgiovense* GenBank: OQE96412.1
MSIPEQTSVLVVGGGPAGSYAAAVLAREGIDTVLLEADLFPRYHIGESMLPSMRHFLRFIDLDETFDKYG

FVQKVEFHLHKAIKKGAAFKLNSFPEAYTDFVAAGGPDAYAWNVDRAEADNLMFQHAGKSGAKVFDGVKV

TSIEFTPLDEQNGQTDSELPSPGRPVSASWARKDGTSGTTQFEYIIDASGRAGLVSTKYYKNRTYNQGLK

NIASWGYWENAKIHAPGTQREGQPFFEALQDASGWVWTIPLHNNKTSVGVVMNQATATTKKKAMEDSSTK

GFYIDTLKSTPETYDLIADAELVSDIKSASDWSYSASTYATPYIRIAGDAGCFIDPYFSSGVHLALASGL

SAATTICAAKKGQITESAAADWHSNKVGTGYTRFLVVVMSALKQITKPEEPVIGDWDEKSFDRAFSMFKP

-continued

IIQGSADVKSNLTSEEISQTIDFCMKAFHPAPKEQREAIFDKLASGSASASGSANPTLSEQTLSADEQRI

LTTMRARNAIRTEDLIHIDNFSVDVVDGMIPRLKRGELGLIDAATAHIKAPNADTKQSVSIFSY

74) Dsg76 from *Stachybotrys chartarum* IBT 40288 GenBank: KFA75658.1
MSIPDSCAVLVVGGGPGGSYAASALAREGVNVVVLEADHFPRYHIGESMLASIRHFLRFIDLEKTFDSYG

FCKKVGAAFKLNNKREGYTDFIAANGPNGYSWNVIRSEADKLMLEHAEKSGAFTFQGVKVESLQFVPDDS

LAEDDTVCNPGRAISASWSRKEDGATGTIKFDYIVDASGRNGIISTQYLKNRKFNQALKNVANWGYWKGA

KTYSPGTPREGSPVFEALTDQSGWCWAIPLHDNTLSVGVVMRQDLSLARKKSLGSPSMVEFYKDCITLSP

DIHARLADAELVSNIKAASDWSYSASTYAGPNFRLVGDAGCFIDPYFSSGVHLALASGLSAALTIQAARR

GDCNELDAAKWHSAKVAESYSRFLLVVMTALKQIRKGDEPVLSDFDEDGFDRAFGFFKPIIQGLADADVG

GKLTQGLISKSVDFCFHAFQEITPDVRQAVLDKLDSVKSDPGVETKQDLEKLSEDELAILRTIRARQMLR

TEDTMNITSFASDVIEGYAPRLVCGSLGLSGMESRTAAPSNAETLFDSGIEMLDENKS

75) Dsg77 from *Bipolaris oryzae* ATCC 44560 XP_007692298.1
MSIPEKTDVLVIGGGPAGSYAASVLAREGVDVVLLESDKFPRYHVGESMLASMRFFLRFIDLEKTFDAHG

FQKKFGATFKITEKKAAYTDFAAALGPGGFSWNVVRSESDELIFKHAGESGAKTFDGTKVESLTFESYSD

GEFSAENHLANPGRPTTATWSRKTGETGTIQFGHVIDASGRNGIISTKYLKNRRFNQGLKNIANWTYWKG

ATKYNAGSETENSPFFEALSDGSGWVWAIPLHNDTLSCGIVVYQELFFAKKKASGLDGLSFYKEYLKLAP

QINSMVANAEIVSEMKQASDWSYSASAYAGPGFRIVGDAGCFVDPYFSSGVHLALTSGLSAAVTIQAVRR

GQAGEEQAAKWHATKVSEGYTRFLLLVMTVLRQLRMKEAALITSEQEEGFDMAFKTIQPVIQGIADTNTE

DADVQKRTAKSINFGLESMNVSSAAEDAVVKKIREAENRPEMLEKLTTEEVSILDRITKRTFAHEKDELN

LTHFTGEVIDGFSARLVRGDLGFVNHAAQPATADQPVVSAAVDMSGLDRNIKQAA

76) Dsg78 from *Bipolaris sorokiniana* ND90Pr XP_007696461.1
MSIPEKTDVLVIGGGPAGSYAASVLAREGVDVVLLESDKFPRYHVGESMLASMRFFLRFIDLEKTFDAHG

FQKKFGATFKITEKKAAYTDFAAALGPGGFSWNVVRSESDELIFKHAGESGAKTFDGTKVESLTFEPYSE

GKFSTENHLANPGRPTTATWSRKTGETGTIQFGHVIDASGRNGIMSTKYLKNRRFNQGLKNIANWTYWKG

ATKYNAGSETENSPFFEALSDGSGWVWAIPLHNDTLSCGIVVYQELFFAKKKASGLDGLSFYKEYLKLAP

QINSMVANAEIVSEMKQASDWSYSASAYAGPGFRIVGDAGCFVDPYFSSGVHLALTSGLSAAVTIQAVRR

GQSGEEQAAKWHATKVSEGYTRFLLLVMTVLRQLRMKEASLITSEQEEGFDMAFKTIQPVIQGIADTNTE

DADVQKRTAKSINFGLESMNVSSAAEDAVVKKIREAENRPEMLEKLTTEEVSILDRITKRTFAHEKDELN

LTHFTGEVIDGFSARLVRGDLGFVNHATQSASADQPAVSAAVDMSGLDRNIKQAA

77) Dsg79 *Arthrobotrys oligospora* ATCC 24927 XP_011122134.1
MAIPQSCTVLIVGGGPAGSYAAAVLAREGIDTVVLEADKFPRYHVGESTIPSLHYLFKFIDFHETFSSYG

FNQKNGAYIKLAKNQPVTSNDFRALQGPNGFAWNLIRSEFDDLVFRYAGTCGARIFEETKVENIEFEPCS

IQTVPGSKEDSSGLFHARKPVSANWVRKIDGTSGSITFKYLIDASGRQGVLSTKYLKNRKFNENLKNVAS

WAYWKSDNVYAAGTPTEGAPYFEALEDCSGWAWYIPLHNGTRSVGIVQDQKLMAKKKASLGRPSTLEFYN

ECIKMAPTIKDLLKGAEFINNIQSASDWSYTASTYHIPNARICGDAGAFIDPLFSSGVHLAMNGGLSAAA

TICASIRGHCDEATAGSWHSKRTVESYTRFFLVVSSVTRQMRQQNEPILRDNDEEGFERGFQIFRPIILG

AVDNNIGNKHSKVGIAKALEFCFEAFTRVTSETKDSTPQDPKTLGFSSGNNTITSHRNLEGLRQNLTPNQ

IEILETLTSRRMIRDDRFEIDSHTFDTIDGYLLNAVRGKLGLVKAEQVKVNI

78) Dsg80 from *Aspergillus niger* Gen Bank: GAQ46952.1
MTVPQSCTVLVIGGGPAGSYAAAALAREGIDTVLLEADKFPRYHIGESTLPSLRHFFKFIDFYDTFDAHG

FYHKNGAVFRLAQAQPDAYTDFLEAGGPDAYAWNLVRSESDDLLFRHAGTCGAHIFDETKVDTIQFEPHI

SESSKPDSDDNKILNPGRPVSATWVRKDGSSGFIALKYLVDASGRNGILSTKYLKNRKFNDNFKNFANWA

YWKTDNLYGLGTHMEGSPYFEALDDASGWAWFMPLHDGTRSVGVVQDQKLVTEKKRELGRPSTLDFYKQC

-continued

VEKAPRTSKLLSGAEIVTTVRTASDWSYTASTYHIPNARICGDAGSFIDPLFSSGVHLAVTGGLSAAATI

AASIRGDCDEETAGSWHSKKTVESYTRFFLAVSSATKQIREQYEPIIQDMEEEGFQRAFDLLRPIIQGTV

DADDTGKISHSEISKALEFCFRAFTYVPPEKKDALFEKLKNLGVGSGQKDAREAKILDGLEQHLTTDELQ

VLEILRSRRMIREDPFEMDSFTLDTIDGMAPNLGSFLFTAISGRLLAAVAVHAAPAEPAHPMVTEAPDAN

LIEKRATTCTFSGSEGASKASKSKTSCSTIYLSDVAVPSGTTLDLTDLNDGTHVIFQGETTFGYEEWTGP

LVSVSGTDITVEGESGAVLNGDGSRWWDGEGGNGGKTKPKFFYAHDLTSSTIKSIYVENSPVQVFSIDGS

TDLTMTDITVDNTDGDTDDLAANTDGFDIGESTYITITGAEIYNQDDCVAINSGENIYFSASVCSGGHGL

SIGSVGGRDDNTVKNVTFYDVNVLKSQQAIRIKTIYGDTGSVSEVTYHEIAFSDATDYGIIIEQNYDDTS

KTPTTGVPITDFVLENIIGTCEDDDCTEVYIACGDGSCSDWTWTGVSVTGGKVSDDCLNVPSGISCDL

79) Dsg81 from *Pestalotiopsis fici* W106-1 XP_007837611.1
MSVPAQTSVLIVGGGPAGSYAATVLAREGVDVVLLEAEKFPRYHIGESMLASIRFFLRFVELEEEFDRHG

FEKKYGATFKITEKNPAYTDFAASLGEGGYSWNVVRSESDEIIFRYAGKCGAKTFDGTKVESLTFEPYPH

EGFDESVHLANPGRPVSANWSRKDGSSGVIKFDYIIDGSGRNGLISTKYLKNRSFNQGLKNIANWTYWKG

AKRFNVGEKNENSPLFEALKDGSGWVWAIPLHNDTISVGVVARQDAFFEKKKESGLSGEAFYKEYLKLAP

QIKNELLRDATIVSDIKQATDWSYSASAYAGPNFRLIGDAGCFVDPYFSSGCHLAMTSALSASVSIQAVR

RGQCDELTGAKWHTTKVAEGYTRFLLLVMTVQRQLRMKDKNIISTDEEEGFDMAFKKIQPVIQGVADTRT

EDEQTQRRAAEAVDFSLESFEITPEKQAAVISKIERSQAEPELLEKLTPEEVHILGNIVNRTFEREKDEL

NLTHFTGDMIDGYSAKLEHGNIGLYKREKALLNGTASRAAAVLKSIHQVA

80) Dsg82 from *Nectria haematococca* mpVI 77-13-4 XP_003040677.1
MSVPSQTSVLIVGAGPAGSYAACVLAREGVDVVLVDADKFPRYHIGESMLAAIRFLLRLIDAEEAFDKHG

FEKKFGATFKITDKREAFTDFSEALGPGGHSWNVIRSEADELLFKHAANNGAKTFDGTKVDSINFEPLPD

FEMGEGSHLANPGRPVSADWSRKDGTRGNIKFDYLIDASGRNGIICTKYLKNRKFNEGLKNLAQWTYWKG

AKRFNVSKRNENSPFFENLDDASGWVWAIPLHNGTLSVGIVARQDLFLAKKKELGLSGQEFYREYLKLAP

QISEMLSNAEIVADVKQASDWSYSASAYAGPYFRVAGDAAAFVDPYFSSGVHLALNNGLAAAVSIQASRR

GQADERAAAKWHATKVAENYTRLLLIVMAVQRQLRLKHEELITSNSEDGFDTAFKAIQPVIQGVADTHES

DASVQNKAVESVNFALESFEVTPEQEKLMTEKVVQAAQRAPETLQKMTPEEVDILKRMSHRVLHRNTNRN

NKGLVDFTGQVIDGFSAILERGDVGLIKVED

81) Dsg83 from *Hydnomerulius pinastri* MD-312 GenBank: KIJ58602.1
MTQTIVPTQAQILVVGGGPAGSYAAAVLAREGFDVVVLEAAAFPRYHIGESLLPSVRHFLKLIDAECLVA

AHGFTAKPGAAVKLNQHMREGYTDFIALNPNHGAWNVIRSEFDDLLLRHAAKCGATVIQRTRVSEIYFDE

DNPDCPISASWKNESGIEGRIRFDYLVDASGRSGIMSTKYLRNRRFNKSLQNTACWGYWEGAEVYMPGTS

RENAIWIEALNDESGWAWFIPLHDGSASVGLVMDQKISMSKKSAAREFSGASDYRLEDHYLSELKRAPGV

LKLLSRAKLRSKGEKEAVKTAGDFSYSATSYAGDHYRLAGDAGAFIDPFFSSGIHLALTGGLSAALTISA

SIRKTASEDLAQRWHSSKVGTSYTRFLLVVLGTYQQIRSQTVPIMSDVDEDNFDRAFSLIRPVIQGTADV

GRVVSEDELQKTMGFCRHIFAPTDPEMHSAVNTRLGSEILSPSGPVLTEAQINELVAQDDLEAKLVLCEV

NARKPIHAMYSPTQHFQLEAHLGHAAVLERRKLGLRRVTPCDTEL

82) Dsg84 from *Gymnopus luxurians* FD-317-M1 GenBank: KIK62692.1
MASTHTSTIPATATVLIIGGGPGGSYAAAVLAREGINVLLLEADKFPRYHVGESQLASLRHFLRFIDLEK

EFENHGFTQKHGAAFKLDKHKREGYTDFVFDDPKNYSWNTVRSESDELMLRHAARSGATVIEETRVMEJE

WDDARPMAATWKNTQSGQMGQVKFDYLIDASGRAGICSVKYLKNRHYNPDFKNVAFWTYWSGCGEYKPGT

SRAGSPYFEALSDESGWAWFIPLHIGTSVGVVVKQELSDEKRATAKTRGLDSSLYGHYMRLLDSAPNIKA

MIANAAIIKNNNEIVVRTASDYSYHSDSYAGPHYRIIGDAGAFIDPYLSSGVHLAISSGLSAAASICSSL

-continued

KGECSEDDAIRFHNAKIDASYTRFVLIIKSVYEHIRSQKATTLSSATEDNFDDAFLMFRPVIQGRIDSSL

SLSEEDKTRLVHFYSRHAFEPSMPEERHNLLKEFGDPVKSFNNADDIHSKAILRSMAVRKLLSVDETNHI

DNYVADVVEGFRLRLERGNIGIEKCR

83) Dsg85 from *Botryobasidium botryosum* FD-172 GenBank: KDQ09292.1
MNVPTHTEVLVIGGGPGGSYAAAALAREGIEAVVLEADLFPRYHIGESMIASVRHFLRIIGLDEKFDNYG

FTRKVGAAFKLNDFKREGYTDFLARGPQNYAWNFIRSESDELMFRYAGECGAKIFDGIKVTDLISQTGDI

VSTRPTSAHWKSKSGSFGIITFDYLIDASGRAGILSTKYLKTRTFNQELKNVATWGYWTGCSVYGAGTPR

NNSPFFEALQAALLLALVAIDESGWAWMIPLHNGTTSVGIVMNQEISNKKKANHPSGRSPSMQEHYLEQL

KFAPSILALVGPGELVKDATTGSVVKSASDYSYSASSYAGDHYRIVGDAGAFIDPFFSSGVHLALAGALS

AALSICAARRGDCTEEEAAVWHSSRVSTSFSRFLVVVLAAYKQMRAQAQPILASADEPDFDRAFEQFRPV

IQGSADVDHSTSARHASEAGSGCARPIEFCEQSDTTRPGGDSTAPKGPMWKTRTEDTFHIDHFATGVING

FCPRLERGSLGLTPVD

84) Dsg86 from *Sphaerobolus stellatus* SS14 GenBank: KIJ40868.1
MASNSDNAMLPAKVTVLVAGGGPSGSYAASILAREGINVMVLESQKFPRYHIGESTLASIRHFLRFIDLE

KTFDEYNFAKKFGAAFKLNQTRDDNYTDFVASDPSNYAWNLVRSESDHLMLQHVVSCGGLVFEETRVTDV

DFEPVLGSSETRPVSAKWRNKAGQTGTVSFDYLIDASGRQGLLSTKYLKNRVINADFRNVAVWGYWSGCA

EYKPGTLRAGAPYFEALTDSSGWAWLIPLNLKYTNESGTASIGIVMNQEIADAKRKDNVNSKPLSAQEHY

LQTLELAPTLKSMIEDAELLRPAGEPVIRSASDYSYSAQSYAGLNYRIVGDAGAFIDPYFSSGVHLALLN

GLSAAATICASMKGECQESDAAQWHTTRVDTSYTRFLIIVKSIYREIRSQQTPASSENGFDKEFEEIAPV

IQGHIDCRTELSASDMEKLVDFYSRHAYEPSTTEERTNILARVQDGSFNNSTLTKRENAILNSLKVRKLY

RLEDINRINHFVEDNIHGRRLKLERGRLGLVEA

85) Dsg87 from *Piloderma croceum* F 1598 GenBank: KIM75794.1
MIFPPPHHPPKHVQVLVIGGGPAGSYAAAALAREGLDVAIFEATKFPRYHVGESLIPSIRHYMRFIGAEE

KLANHGFVRKPGSAIKFNQFKREGYTDFVALGHNNNAWNVVRSEFDEILLKHARSSGAKVTELIRVKSLS

FSSTDPSKPISACWTHSPSFCFSSSSSSSSSGTDDDLPNAPITGTTTFDYVIDATGRAGLISTNYLKNRH

FNASLKNIAIWGYWKDVDTYGVGTEREGAPWFEALTDESGWAWFIPLHDGTTSIGIVMNQKIFNADAKTT

DSSPSPSLTSRYRSYLPLAPGLLELIGDGVLTTKPVSPPNSPNGSDSTANDFRSKEPLVKSATDFSYSAD

QYAGHGYRIVGDAGSFIDPFFSSGVHLALTSALSAASTICAALRGDCSEQEAAEWHTKRVATSYTRFQVV

VLSAYKQIRAQSTDVLSDINEDNYDRAFGFLRPVIQGASDMGTRLSENELQKSLDFCVNLFSPTSPEQHE

RVANSGVSKNLLDVNAPLMDSDTLEGALRKLAETKMVVNKINARRVVHSEYAINNLESEGLNGYVVRLEK

GKLGLTRVLLRTLIPFNLLRILPNVRDEAVFDLISDTSSDLEKNFAKSS

86) Dsg88 from *Botryobasidium botryosum* FD-172 GenBank: KDQ15003.1
MSAAVPQKTQVLVIGGGPGGSYAASALVREGHEVVLLESAKFPRYHIGESMLPSMRHFLRFIDLEDEFEA

HGFAIKPGAAAKFTAHKKEGYTDFVEKGQTKGTWNVIRSEADEIMLRYAGRQGANIIEETKVTSINFAGD

PAESRPISAEWKNVQGQTGTIEFEWLVDASGRDGIMSTKYLKNRRFNEAFKNVAFWGYYTGTGKYEPGTH

RENAPFFEALNDESGWAWFIPLHNGTTSVGVVMNQEVYTQKRKSEKATRPSLQEHYEGQLAEWAPTIMRL

IGEGKIKTNVEGPTVKMASDYSYNAPSYAGDHYRIAGDAGAFIDPFFSSGVHLAILGALAAATSICAEIR

GQCKSADAEKWHTDKINVSYTRWLLVVMSAYKQMRASNEPVLADVDEESFDRAFDFFRPIIQGSSDYGKS

LTRDELNKAIDFCGAIFHEFKPEDIDAAVERAGPAVLEGNAIPGAAPAAVDPEDEKAQEVLKLLSASKHV

MTKEQDHGLHVFGADAVNGLKVILERGNLGLYRVDSE

-continued

87) Dsg90 from *Aspergillus carbonarius* ITEM 5010 GenBank: OOF93604.1
MAIPQKATVLVIGGGPGGSYSASALAREGIDTVVLEADVFPRYHIGESLVASIRPFLKFIDLDDTFVNYG

FVRKNGAAFKLNNQKEAYTDFILEAGADTFAWNVVRSESDDLMFKHAAKSGAQTFDGVRVTSIEFTDDDD

DDDNNTNRPVSASWKAKDGRTGSIEFDYLVDASGRAGITSTKYLKNRTFNNYLKNVASWGYWEGATPYGM

GTPVEGQPFFEALQDGSGWVWFIPLHNNTTSIGIVMNQELSTQKKKLSTTTSSRAFYLESLAGARGISRL

LDPTTATLTSDIKHASDWSYNASAYGSPYLRIVGDAGAFIDPYFSSGVHLAVSGGLSAAVSIAASIRGDC

PEEAAWKWHSQGVANRYGRFLLVVLGATKQIRAGDRPVLNGVGD

88) Dsg91 From *Rhizopogon vesiculosus* GenBank: OJA19373.1
MSQQIPKNAQIVVVGGGPSGSYAASALAREGLDVVLLEAAHFPRYHIGESLIPSVRHYLRFIDAEQKLVD

MGFKHKPGAAMKFNQFKREGYTDFVALGHSNSSWNVVRSAFDKMLLDHATSCGTKVFERTRVESFRFSAT

DNSRPVAAEWFCAADGKRGVISFDYLVDASGRSGLMSTKYLRNRHFNASLKNVAIWGYWVGVSKYGINTP

REGAPWFESLTDESGWAWFIPLHDGTTSIGIVMNQAIYNEKVRTLKGSSLEDRYRFSISLAPGLVRLIGS

GRIVQKEGVERQSGQFDLLIRSASDFSYSASSYGGPGFRLVGDAGAFIDPFFSSGIHLAMTSGLSAAVSI

CAAVRGDCSEIDAAAWHTKRFSLSYTRFQMVVMSAYKQIRSTDLEILTEVDEDNYDRAFAAIRPVIQGAG

EMGSRLSEKELESALEFCSKCFNPASHEHLAFAAKQDLPKDILDVTGPIIDPQVIDSVISKTSEHMDSKG

GQQLFGSVEDLKLLLDQINGRRVVHREYTINNFEVEDVNGFVVRLRKGYLGLMRTSTTSKVN

89) Dsg92 from *Hebeloma cylidrosporum* h7 GenBank: KIM45198.1
MPSALSVSSLPPKLTQVLIIGGGPAGSYAAAALAREGIQVTLLESSKFPRYHVGESLIPSARHYLRFIDA

EKKMINCGFARKPGSAIKFNQYKREGYTDFVALGHNNNAWNVVRSEFDLMLLNHARTTGASVYEQTKVDS

ISFSSSDPDRPISVSWTHTPPPCPPSPPASPTDGVFPSLFSSKIVTPDQPPPPARGETAFAYLIDASGRA

GILSTRYLKNRHFNASLKNIAVWGYWKNASQYGSGTAREGSPWFEALTDESGWAWFIPLHNGTTSVGIVM

NENMYKAKYQQPPSSVFAAGSSSNSHVTIRYLSNISLAPGVVKLITPSGVLDEGSVKSASDFSYSAPSYA

GNGYRIIGDAGAFIDPFFSSGVHLAMTSALSAAATICASIRGHCSETRSADWHTRRVSTSYTRFQVVVLS

AYKQIRAQSHDILSDINEDNYDRAFSFLRPVIQGASDMGARLSETELQKSLDFCLNLFNPTTPEQHECLS

HYGDVAKELLDVAGPVVDPSIFERSLHVSQASMGDTEDAANSSDCEKAVETRMILNKINARRVVHPEYAI

NNLETESLDGYVVKLERGKLGLTKAPF

90) Dsg93 from *Paxillus involutus* ATCC 200175 GenBank: KIJ15465.1
MSSAIPTHTQILVVGGGPAGSYAASALAREGLQVILFEAAQFPRYHIGESLIPSVRHYLRFIEAEQKLAE

YGFKHKPGAAIKFNQFKREGYTDFVALGHSNSSWNVTRSAFDKMLLDHARESGACVHEKTRVNSLRFSSS

DPSRPVAAEWSQSSETDHSGVISFDFLVDATGRGGLMSNKYLRNRHYNESLRNIALWGYWSGVGAYGGGT

AREGAPWFEALIDDSGWAWFIPLHDGTTSIGIVMHQELHNEKSKALHGSSTVSRYQAFLSLAPNLTALIG

RGVLVSKLSVDGPPGSLDPLVRSASDFSYSASAYGGNSFRIIGDAGAFIDPLFSSGVHLAMTSALSAAAS

ICGSIRGDCSEAIAAAWYTRRFSLSYTRFQMVVLSAYKQIRATNFDVLNDVDEDNYDQAFASIRPVIQGA

SDMGTRLSEAELQGALDFCSKLFSPTSPEQRACALRYGLPTKVLDVSAPLLDPKDIDAALSRVEGISSDG

NLNHDARLVMEHANARRVLHREYAVNNLEAEEIGGHVVRLERGSLGLMKLRG

91) Dsg94 from *Amanita thiersii* Skay4041 GenBank: PFH50120.1
MDTVPSSTTVLVIGGGPGGSYTASVLSREGFDVTLLEAVKHPRYHVGEGMLPSMRHFLRFVDMEEEFHNH

GFKHKPGATFKLHHSTPETFTDFSTLGPSRTTWNVIRSEADEMLLRNASRQGVKVFEETRVTSIDFEGDP

ATSRPIAADWTNKKGESGKIKFEWLVDASGRAGIMSTKYLKNRNFREGLRNIATWGYWRNVKIYAEGTKR

SNAPWFEAMTDGLGWAWLIPLHDGTTSIGIAMHQNVSDMKKKNHPGGKPSLTEHYLDQIKFLPGVLELLG

EQGELVPGSVKSSTDYSYSASRYSGDHFRIAGDAASFVDPFFASGVHIAMTGALSAATTICASAKGQVTE

-continued

SEAQHWHDAKVGICHTRFLIVVLSAYKQMQSQNRPVLSDVSEDNFDRAFSLFRPIIQGAADTTNKLTEEE

LEGMLDFCMHLFDPGEHAGVAQRLQPDLLALHGPVMGSAELDKALPPEDVEAKKFLSRFNALKILRNDTS

PESFGTEAVDGYTVQFERGHLGLVKAPST

92) Dsg95 from *Hypholoma sublateritium* FD-334 SS-4 GenBank: KJA20552.1
MSTPAIPSHTTVLVIGGGPGGAYSSTVLARDGVEVTLFEAAQFPRYHIGESMLPSINAFYAFVGAQDKLR

AAGFCPKPGAAVKLQQGKKEAYTNFIERNEHDASYNVVRSELDEILLRHSQEAGTAVFEQTRVTDIVFDE

KAPESDPRPIGANYVRNGTTGYISFDYLVDASGSKGLMSTKYLKNRKMNQTLHNIACWGYWSGQGMYMPG

TYRHNAPWFEALSDESGWAWFIPLHNGTVSVGFVMDKAISIQKKADLREKDPEAFSLKAHYLDQMQYTPG

LRELLKNATMKDGDLEGSGPVKSTSDFSYSASNYAGDHYRLVGDAACFIDPFFSSGCHLAHLGGLSAAMT

ICASLRKHCTEAQASHWHDTKVATSYTRFLIVVLSAYKQIRSQVNNILSDVDEDNYDRAFDFFRPVIQGT

ADVGKKLTEDELQKTIEYCTNIFLPGDPELRESVGERIGVEMLSNTQPIMSMDEMEKITGGEEDAMMALK

QVNARKPLVGLYGALDSMKSENIGGLVAVLTRGQMGLSVAEPAT

93) Dsg96 from *Termitomyces* sp. J132 GenBank: KNZ80988.1
MSSLKHPPQVPFSDRRPPSADPFQHTQVLVIGGGPAGSYAASALAREGLDVTLCEAATFPRYHVGESLIP

SARQYLRFIGAESALVDHGFVFKPGSAIKFNQFKREGYTDFLALGCENNAWNVVRSEFDQLLMNHARASG

AAVYERTKVTDVSFSSTDPTKPVSVTWSHTPTPSVSPSTAPWAPLTSFLGKIMSPLTVLKSPVITGTTTF

NYLIDATGRAGLLSTKYLKNRHYNASLKNLAVWGYWKGTTLYGAGTARQGSPWFEALTDESGWAWFIPLH

DGTISIGIVVNHKIFDRALKQPLPPSPFSHPSTFNPTNSKIIAYYLSALALAPGVVELITSGGSMVEGSV

KSASDFSYSAASYAGSNYRIVGDAGAFIDPFFSSGIHLAFTSALSASATICASIRGHCPELSAAEWHSRR

VSTSYTRFQIVVLSAYKQIRAQKMDILCDIDEDNYDRAFAFLRPVIQGASDMGVRLSETELQKSLDFCVS

LFNPTSPEQHERLSRSSGLCNEVFDINAPLVDPAIFRDALQIGFQSLDSCSEIDSDSDTDGDQSFSESDR

VLETKLILEKINARRVIHSEYHLNNMEVESIGGYVMRLEKGTLGLARTTHKAR

94) Dsg97 from *flavobacteriales bacterium* TMED228 GenBank: OUW92352.1
MATKIQNIIVLGAGTAGWLTALFVRKLFPHYNIKIIGNKKIGIIGVGEATTPPFVDFLREIDIDPLAMVR

ETGGSIKQGISFEDWNGDGKKYFHGFYEKFLSDVSIPPIFSHDCGDYYYKHLIHKKLDFNEYSYATKLSY

QNKTDLDGIAYAIHFDTNRLSTYLGKIAKERNIEYVEGEYSKMKLKYDFIFDCSGLSRLIIKDKSKWKSY

RKYLPMKHAIPFHLPVKENKPYTSAIAMKYGWMWQIPLQDRIGAGYVFDSDYIDAAQAQEETEKFLGHKI

DVRKVINFEAGRHEKYWVDNCMAVGLAACFIEPLESTSIHLTVLQLQLLRQFASDLFDGTNDMFNEVITN

TMDEILYFIYLHYITKRKDSSFWRNFKKDYPCPPAFKPVLQAIQNNNLKHYDIKSTNRIQPGFSVTSYLQ

IANGLGLFKKDINIKEYTNLTPTVKEIKKFIDQKTQSI

95) Dsg98 *Metarhizium anisopliae* GenBank: KFG78717.1
MAVPPSCTVLVIGGGPAGSYAAAALAREGIETVVLEADKFPRYHIGESTLPSLRHFFKFIDFYDTVDAYG

FYHKVPSSLHFFHLNEELTSPYQAKNGAVFRLAQAQPDACKSPSPAYTDFLEAGGPNGYAWNLIRSEFDD

LLFKHAGTCGAQIFSETRVDTIQFEPVANGLKPDMNRNLGDNLNPGRPVSATWVRKDGTSGSITYKYLVD

ASGRQGILSTKYLKNRKFNNNFKNAAIWAYWKSDNVYGPGTHMEGSPYFEALDDASGWAWFMPLHDGTRS

VGIVQDQKMATEKKHELGRPSTLDFYKQCLQMAPGIRELLSEAELIPHVRAACDWSYTASTYHLPNARIC

GDAGSFIDPLFSSGVHLAITGGLSAAATISASIRGDCSEAAAGSWHSKKTVESYTRFFLAVSSATKQIRT

QHEPIIKDMDEDGFQRAFDLFRPIIQGTADADEAGKVSQLEISKILHFCFKAFTYVPPEKKDALFDKLRK

LDSKALQDDAKQVQTLDGIEKHLTADELQILEILRSRRMIREDPFEMDSFTLDTIDGMAPRLVRGTLGLV

NYEQAKIDKAHFYSQDFLDGNYPGIREGSVHLPTSRVQLG

-continued

96) Dsg99 from *Deltaproteobacteria* bacterium TMED58 GenBank: OUU34213.1
MKICIIGGGTSGWWCAAYMQKFLDAEITLIESKEIPTSGVGESSLPQIGAFFEELGIPEEEWMNGCNAVH

KYGNMKYEWDGVGKDPFLMTFWQDDPKGRFDKWYQEYKSGVKDKNSHTELYNRDGWRSVAYHLDANLANS

VVKDYCKDVNHIIDTLDELPEGYDLYVDASGFARKFTTDKTEVIWDHHLVNSAWVCPFQLEGEINPYTQT

IARECGWQFIIDLQNRTGSGYVYSDKYISDVQALEHFKGWTEGRKNYNNIVPRLIKWRPNVLKNSWKDNV

VTIGLGQGFVDPLEANGLYMVVYSITLLVKCILKGSKPEAYNKAMLKVQKQNSDYLLHHYMLSDRKDTPF

WEYYSKFDMDESLWKNYKKYPNKYNNLYPDALWAQLGIYFEKFKHYTP

97) Dsg100 from *Ophiocordyceps unilateralis* GenBank: PFH59609.1
MAVPKSCTVLIIGAGPAGSYAACCLAREGIDTVVLEADKFPRYHIGESTLPSLRHFFKFIDVDDAFDAYG

FFKKGSSRNGAVFRLNQAHPDALTDFIEAGGPDGYAWNLIRAESDDLLFRHAKACGAHTFDETKVDSIQF

ERGTDRTCFGEGQDKAMDSGRPVSATWSRKDGSAGTIAFKYLIDASGRHGILSTKYLKSRRFNRGFKNVA

SWAYWKSDNLYGQGTSWEGLPYFEALQDASGWCWYMPLHDGTRSVGIVQDQAMATDKKRKLGKPSTSEFY

RQSLELATRTNELLSGATLASDIKSASDWSYTSSTYHIPYARICGDAGCFIDPLFSSGVHLAIAGGLSAA

VTIAASLKGDYDEETAGSWHSKKTVESYARFLLAVCAATKQIRYEDEPVMHDFDEEGLQRAFDILQPIIQ

GTVDGEARGRTTDIEVSQVLKFCFRAFNYVPHEKKEALFEKLDRLDPGFGEGDAAKRIEEMHKHLTAEEM

EIVEALRSRRLIREDVFTLGSFTLDIIDGLAPRLVRGELGLVKASKARLDSRHFLSAPFLDGKVEAIRTH

GEGI

98) Dsg101 from *Amicolatopsis coloradensis* GenBank: OLZ53805.1
MVIVGGGTAGWLSAAYLNRAFGGKVDITLIESPRIPRIGVGEATVPTLRTTFAFLGMKEEDWMPKTNAVF

KSAVRFNDWRKPHEGRDSHTYYHPFFDVPEPAVQNYEKPFHKRFGRGVSLAHFWLKQRLAGDTRVRETFG

DAGMALQRLCELNKAPKPLPGTDAPDPGYRYAYHFDAALIAKYLRELATGRGVKFVSADVTSVTVDPRGT

IEKVVTDTAGEIEADLFLDCTGFRGLLINKTLNEPFVSANDVLLCDSAVALPARHREGGLRPYTSATAKP

DGWIWEIPLADRDGTGFVYSSAFTTPDKAERRLREHLGGRGYDIDGNHIKMRVGHNRRSWVNNCIAVGLS

SCFVEPLESTTIALIEYQLALLVLHFPDSDFDERRKARYNELMVGAFEDLRDFIVMHYTLTDRDDTEFWN

AVREAPIPASLEEKLTEYAESVIIPDGSQLRLFETRSIWAILSGMDFGFKKAPPSVEKMNDAAAWEMFEK

IDKEREIYSAGLPGHREYIEALHRGF

99) Dsg102 from Aphanizomenon flos-aquae WA102 GenBank: OB045584.1
MTKNIVVVGGGSAGWLTALTAKKKYPKLNVTVIESKDIGILGAGEGSTPYLPLFLETLDISIEDLVKNCD

ATIKNGIKFSNWNNDNDFYYHGFGFIDPSLGTEALSSKFLSASPMLVSSIALNNDLKDLDFTENVSEKNK

VPFVLEKNKSGKTVSEYKKIGKTSFHFNATKLAERFKDIGLERGIEVFENTITKVSLDENNNVVGLDLDS

GITIPSDFVFDCSGFHRLIIGKTFNSKWKSYKEFLPVDSAIPFFLDMTEKIPPYTEAIAMKYGWVWKIPL

QNRFGCGYVYDSSLISQEEAIKEVEEFLGFTPYYPRKDKGGFSFSPGSFEEPWQNNCVAIGLAANFVEPL

EATSLWVSMVALTEIFSSPDFLTNNSDEIRSEFNKLILNMNDDILNFIYLHYMSLRKDTEFWKKFSYEMA

PDELKQKLKVWEKRMPGKRDNGNFWNSASWFVVASAQEKINKGLAQEYVDMSDEYKKAVDSYEYYKKYRE

YKVTECTDHRQFLEGLK

100) Dsg103 from Rhodobacteraceae bacterium PARR1 GenBank: OYU17741.1
MTFWPRMATGCRNGRACHSARQAKTMWPRRICVVGGGTAGWLAAMMLGDSARRGGHPCEVTVIESSKIGT

IGVGEGTTAVFRQMLQHFGLDEMEFLAETGATIKFGIRHRDWRRLGHSYDGPIDDPHRVTGFEVNALDLY

QVSRGESVGQVHLFQHLLSRNKSPFAVVDGRHIAVGPFHHAYHFDQALAGKWLRSKAKAIATIDDQVLRV

ERLAESGDITALHLEGGARVEADLFVDCTGFRRALIGPMGGTWVSYRDMLPVNRAIPFWLDIPKGEEIDP

CTLAWAQGSGWMWKIPTQSRYGCGYVFSDAHITPDQAKDEIERVLGRPIHVRNDIRIDAGRLDRQWIGNC

VALGLSSSFLEPLEATSIHGTVVQLMLLASVLPNPDDRARLAFNAASARQVDDFRDFIRLHYVSERRDTP

-continued

FWRDVAGNLPPHLADRLAAWGGRVPGAADFAPFPMGLPHTDHHLHVPVLDGLGLLDPAKAKDWLAAHPKL

RAQARAEAAKLTGEYKRAAGRAMGHRAFLDGLGVTA

101) Dsg104 from Gammaproteobacteria bacterium MedPE GenBank: OIQ47327.1
MPQKAIKTLVIVGGGSAGWMSASFLNHIFNLKEKQIDIKLIESSEVETIGVGEATIHSIRFFLSTIGISE

REFMQKTQAIFKHGILFKDWSGQEKDEYYHPFEHPKVNDGIDVVRHWVNLNSNTEKSSRFDFSVSAQSLC

ASQNKSPKSQGNKDFEGYFPYGYHLDAAKFAHFLRDFSLTKGVKRIEGHVQEVILGTDGDIQRLILKNGL

QIDGDFFIDCTGFSSVLMKAMGNKEWVDYSDSLLCDRAVTCQLEHNKENQEHRPYTIATAQKSGWIWDID

LQSRRGMGYVYSSSFCSTEQAEIDLSVYANTAREKLSFKHLQMKTGRMEKIWFKNCLAIGLSAGFIEPLE

STGIYFIDMGIRFFGDYITSGNVNTLLIDKYNTVMGQLMDQSKDFISLHYTLSKRNDSQFWRAYQHDVPI

SETLSANLTLWKHKIPTAIDFSAQITQFTSANYTYILYGMKYFPEPAVTSNLFTSEDRSMKNIEYVKSRS

NQMNNKLPTMSQFLKNI

102) Dsg105 from *Asticcacaulis* sp. AC466 GenBank: ESQ85779.1
MIISRLNGKNGKPPIMTKIASEPASPPHRDVLIVGGGAAGWMTAAYLAKHLGTDRNGGPRITVMESPDIG

IIGVGEGTFPTIRNILRTLGIDEAGFMRESHATFKQGIRFDDWEVTPKDGRRSHYFHPFEQPYWSREELN

LLPYWLLQDKDKRLPFAEAVTFQKKVADSKLAPKRIHQGNYQGPLNYAYHFDAHRFAGVLAKYAKDLGVH

HLSGNLDGVTLDADGAIAHITAKEHGDLKADLYIDCTGFRSEILGKAMGVPFKSIKDTLFTDRAVAIQVP

YEKPDSPLESYTISTAHEAGWTWDIALSTRRGIGYVYSSDHTDDDRAEEVLRAYVGPMAEGVEARCIRFN

AGYRTQHWVKNCIGVGLSAGFLEPLESTGMVLIESAVNKIVEFFPFRGPLDASAHIFNEAMTKRYETIIG

FIKLHYCLTKREEPFWRDNTRPDSIPPHLRELIALWKFRPPSRFDFTLDNESFAFFSYQYILYGMNFETD

YEAARGSLQHTDLANHLFARISQFGDQASKDLVSHRQLINAVYKGGFVERPNAPMAVAR

103) Dsg106 from *Asticcacaulis* sp. AC466 GenBank: ESQ83834.1
MFMNSVQQQEIVILGGGAAGWIAAALLARKTDRSQTRVTLVESEEIGIIGVGEATVPVLAHCNALLGIDE

YDFIRNTQGTFKLGIEFCDWGVAGNRHFHAFSDYGHQVDGVSTHHYWLRLRQSGDAHPIDDYSFAYAVAK

NNNFAPTDPQNPRYHHAYHFDAALYARYLRDVATGQGVQRIEGKMTHFDLESASGNITAIHLANGSRVPG

DLFLDCTGFASELLGKALETPFVDWSRWLLCNSAMAVPSKRTGAPMPFTRSTAHAGGWRWTIPLQHRCGH

GMVYNSDLWSDDAARDALTGNVDGELLAEPRVFRFTSGHRKQFWNRNCVGIGFASSFLEPLESTGLQLIV

QGVLKLLQFFPQRIIDPVLRDEYNRISTREIERIRDFIIAHYYLSRRPEPLWAACRNIEVPDSLRHKLEV

WNASGQIALGDLESYMEPSWLAILLGNGVVPARYAVAADLYPLEQIRKGMKLRREEIVRSAQAVTSHQDF

IDQYCKAP

104) Dsg107 from *Dyella thiooxydans* GenBank: AND70239.1
MAQRPEFPAGLRPFFAIGQVSEDDGTAAGEEPAMARINKVLVVGGGTAGWLVACYLARAMRSSDPSGIQV

HLVEAENIGLLGVGEATFPSIRGTLAAIGLDERHFLDGAHATYKQGIHYRHWVRPPGTPGRDAFFHPFNQ

PSQRPGGPELLPYWLLGEAPAELPFAEAVTLQSRVVEGGRAPKRPQDPDYQGPLNHAFHFDAACFARVLA

EHGTQTLGVHRHVATVERAELDERGAIARLITTELGPMTADLYVDCTGLRSHLAGGTMQSPFLSRADVLF

ADRAMAMQVPYDRPDAPIPSYTIATAHEAGWTWDIGLQQRRGVGYVYSSRHTDDARAEQVLRGYLGNAAE

GLTPLRIRFETGYRPEHWRHNCVAVGLAGGFVEPLESTGIALVELGAYLLTHALPADLDDLPRIARHYNT

MMVARYERIIDFIKLHYCLSQRRDTPFWRDNTAPGSIPQTLQDKLALWRYRPPHRLDFVGDLEMFLVASW

QYVLYGMEFRTDLTPMRRSYTQVAEARQEFATIQQVAARAQDDLPDHRAFVERMVREHRERAGRAHAAA

105) Dsg108 from *Euryarchaeota archaeon* TMED97 GenBank: OUV27629.1
MKIKNVCIVGGGTTGWMMAVALNVNVPNLKVTLVESEEIPSIGVGEATIPLTAKFISSVLKFDEKEWMAA

SDATYKTAIRFNNFSKIDESFWHPFWSDDEIHYNTYDWLIKRQIEDLPTEDFYKSNFIAWYMSMDKRFQE

IKGFQHAHHMDANKFARYCQTQFKGTHINATVSSVEEKDGYIKSITVDGKKIKSDLFIDCTGFNALLIGE

TLNEPYTSYEDTLLNDSALVCRIPYGNDPFTNRQQECHPFTDCTALSSGWVFNTPVWSRTGTGYVYSSKF

QSREDAEQEFRIYLVDRFGGDRGDIAEFRHISFKTGKYERSWVNNCLALTLASGFIEPLESTGLALACWQ

IENFIDVLKDDDMSSFIRATYNDKVNMAYDEIHTFIAMHYANTKREDTEYWKHIKNNLHITQKMVDYAKN

DNVPDIWFPKKSRECVLIGLDIPSEYSKQHITWHGENFESIMKSDDNEKEFMTAGVQYLNGRKNMYQSIS

NDMPWHEDYLKEHIHVESEDS

106) Dsg109 from *Albimonas pacifica* GenBank: WP_092860541.1
MTAMSGGPDPLRVLVAGGGSAGWMAAATLDAALNRGGARAVAITVVESPDTPRIGVGEATIPTIRRTLRR

LRIPEAEFLAAAEATFKQAIVFADWSGPGSGFAHPFHTRPGDGAEQAAARFLRSDGRTPFADLVTPQPAL

AAAFRGPRRAGDADYVGPLPYAYHMDAEAFAELLAARAVTRGVARVSAHLRPPERAPDRPLEAVEATDGR

RFAADLFVDATGFRRLLIGQGGFLDQSRHLICDAAVALRAPCAPGPTRPFTVAAAREGGWTWDIPLRTRR

GRGYVHATAHLAPEAAEDALRAETPGAGEARRLRFQVGRLAQPWQANVVAVGLAAGFVEPLESTGLHLAD

LAAGLLAENAPLAGPNPGLARAYNALLAAAHDEVVDFVNLHYAASPRRDTPFWRDAADPARRTDRVAHLL

ELWEARPPVAADFPSSLQAFNHRNWEFILHGLGWRPRALGPAGGPPLAPDPELAAEARRLAAELPGHDAL

LAALAPR

107) Dsg110 from *Pseudoalteromonas byunsanensis* GenBank: OHU95107.1
MTATLINQAYNKHHKLVDIRLIESPDVDIIGVGEATVPAIKDFLQAAGIDEAEFMNYCNATFKNGIMFEN

WRQPKHGKMHRYVHPFDFERVEKRLDIATSWVLSERQRPFDESVSLASTLIQHNLTPKTRTTKPYHGIVH

YSYHMDARLFGQFLRQRAMAAGVTRIEAHVESVNTDNGQISSIATTQGLFESDLFIDCTGFRALLISALE

EKSSNWRSYQDELMCDSAVTVQIPHSEEHIPRSYTVAHALSCGWAWSIDLQNRTGNGYVYSSKYCSKEQA

ELEFRNYLKLDNNVALNHIDMSVGRRKRHWIGNCVAIGLAGGFIEPLESTGLHLIFLAARFLVLHNNFQY

CEANIAGFNQTMNATYDELKDFIVTHYVLSDRDDSDFWRDISKTLDACPQLAQKLDLWQSKVCEFFDVSN

STSHMFTDTSYRYILFGMDHIPQIKIPYFDGEFTDVFEFVKSRQQKAVAIALNHVDYFSYDVKGQVTVKL

SQ

108) Dsg111 from Euryarchaeota archaeon TMED129 GenBank: OUV65970.1
MRVESIVIVGGGSSGWMAAAMLSKTFPKMQIGLIESEQGPIGVGESTLGHFNRFLKRLGLKDKDWMSYCN

ATYKTSIAFKNFRHGEGERFQYPFGEFDLFDYKDTLQRYFELGCKYGVDKYPPDEFANFANNQTYLADQC

KISADPIPECTYDMDRDTAYHFDAGLFGNYLRDHHCIPNGVMHLKGEIEKVMKNPDGSIDSLVTTQDGLI

KADLYIDCTGFKSLLLEQHMGSEFISFKDKLFNDTALATQIPYSDRENQMETYTDCVAMNAGWVWNIPLW

HRVGTGYVYSSDYINECEAEVEFRKYLSERYTPEIAQDAKLRKINIKHGKHEKAWVKNVVGIGLAYGFLE

PLESTGLMTTHENILLLCDTLQRRQGFYSRFEQDSFNYNCDNMIESMKNFVALHYALSQRDDNKYWRDCT

NINFDIDPLWKQSTRVAHSNVVTMLDNLEDAFYNLEQHSGSIYIAAGQGYRPFSEGMFEERMSADKESDE

WSSILEEIHTKYQQDRKIMMEWVDKLPSHYEYLRDNIYDLQEEETVG

109) Dsg112 from *Nostoc minutum* NIES-26 GenBank: RCJ37336.1
MNFHIKKVAIVGGSSAGLLSAVTLKYFFPKLHILLLYSKKHAPIGVGESTTAWFPQFLHEHLNISREEFY

KSIWPVWKLGIRFEWGVPHISHFNYTFDGQFRYESQLLSKIPGFYCMHDMRQASRYSILMDKHHAPLLHD

GKGNIKILSDGFGYHIDVYEFINYLTAKALSLGVDIQDLEVLDAKLDEYGNVQHLCCADDLKVNADLFID

CSGFKSQLLGKALQEKFISFGYRLFCDSAIVGNWKRRSPIFPFTTATTMNSGWRWRIDLRDRVSFGYVYS

SSFCSQDEAIQEYLSLTPYATEDLRKISFRSGRYKRFWVNNVIAIGNASGFVEPLESTGQHMIVETIWRV

VLALQDSNLCPTPKLIDATNRYVVDLWDEICDFLTLHFKFNRRLDTPFWKYCQEETDLGSLQNLVELYQD

SGVCHAIAHLIPKSSIFEIDGYLTLLCGQQVLVKNLQPMADAEITEWLKYRQILHNNLENSVSPQEAFYF

LESLY

-continued

110) Dsg113 from *Cylindrospermum stagnale* GenBank: WP_085960655.1
MHVEKTIHNVVVLGGGSAGFLSALALKVKMPSLNVVVVHSKTIPVIGVGEATTAWIPWFLHTYLGLNRQQ

FYEETQPIWKLGIKFIWGNSHQSHFNYPFVTHLADKLSVLDKSTAYYCLDSTRESSIYSLLMEQYKSPCF

RKENGDFVFDERFGYHIENASFVSYLERRAAELDIKIIDQPVVNIQVAENGYIHQLKLDDGTTLAGDLFV

DCSGFRSTLLGEILQEPFCSFSSSLFNDSAVTGTWMRDDVIYPFTTAETMQAGWCWRIDLPEQVNRGYVY

SSAFISDDDALAEMKRQNPLMGDDHHSVVRFKSGRHQRFWVNNVVGVGNASGFVEPLESTGLHMIGETIK

CVCDVLIDSDQQPTPGLINLANQAIAEKWDDIRDFLSIHFKFNRRVTSDFWQHCWQQTDIGEAEAVVDFF

QNNGPSPIGQLLLRKNSVFKYNGYLNLLMGQQVATKYQGNNEILDLDNWRQVKNYFLKNCDNALPIHEAT

QVVKERKCQWLSS

111) Dsg114 from *Nonlabens* sp. 1Q3 GenBank: WP_124981671.1
MKIYIIGGGSSGWMTATTMLTKFPDADITVVESPSKPPVGVGESTTQYFRIWADYVGLKDEDWMVACDAT

YKISVRFSNFHDVDDTPWQYPFGSPNYNLAHPDVWFWNQYKRGWSNDKFARDYWIAAECAEHNLLPIKDP

NFKIKKNTGFHFDAVKFAEWLRDNKCQSVKRIIGTVDDFERVGDDIKYLWIDEKQHEADLYFDCTGFTSL

LNNSEWLDYSDWLPNDTAWVTRLEYKDKQEELKSYTQCTALSSGWVWTVPTFARIGTGYVFSSKYQDHQS

ALKEFASFLKYDTEEFRKIHFKTGRKKEIWCGNVVSIGLSGGFIEPLESNGLLSVHEFLLKFCRMWKPRT

TQMMRDTYNKAVAFAFDGFASFVALHYALTQRQDSDYWKAVSQIRYPDGNMIEAAKITMLEESHNFGTKL

NWQNADGDSLYCVMAGHGWNPFTDVIESEILFHGGIPEDSHLNSWTHQWNHARLGVNPLDYYNRTLYAV

112) Dsg115 from *Actinosynnema* sp. ALI-1.44 GenBank: ONI77922.1
MDHKELAAGMGAGHRTELHAVLESLGESEAAAVRSWLGGGETPDPLALLGELAPVPSDLSRPDDADPQAI

RRIGVIGGGTAGYLTALALKAKRPWLDVTLVESRQIPIIGVGEATVSYLTLFLHHYLDIDAEELYRCVQP

TWKLGIRFDWGPHPDGFMGPFDWSADSVGLLGALAATGNINGSTLGSAMMVADRTAVFDVDGRPVSLMKY

LPFAYHLDNGRFVSFLTDLARRRGVHHVEATLADVVVSGAEWVDHVRTDDGRELRFDMYVDCTGFRSRLL

GQALGTPFTSFASSLFTDSAVTGNIDHGGHLRPYTQATTMNAGWCWRIPTRESDHRGYVYSSAAISDQEA

ADEFARRYPGVDGLRQVRFRSGRHEKSWRGNVMGIGNAYGFVEPLESTGLLMIAVAVHSLVSTLPGSWSE

PSPRELVNAGLGQQWNAIRWLLAIHYRFNTRLDTPFWKEVRATADVSGFDTLLEVYAGGAPLSQRHVLVQ

DVLNRIAPTFFGLFGIDYLLLGQQVPTRRMPLAEPIERWHARKHAADALVAAALPHREALDAFDAHPELN

KQLLEDTDSWAGRSIAKRVGLL

113) Dsg116 from *Nostoc calcicola* GenBank: WP_073644584.1
MEKTIHNVVVFGGGSAGFLSALALKVKMPALNVVVVHSTTIPIIGVGEATTAWIPWFLHKYLELNREQFY

EETQPIWKLGIKFIWGDSSQSHFNYPFVTHLADKLSVLSKSTAYYCLDSTTESSLYSLLMEQCKSPCFRR

ENGDFVVDERFGYHIENVSFVSYLERRATEIDIKIIDRPVVNIEVAENGYIRQLKFDDGTMLAGDLFVDC

SGFRSALLGEILQEPFCSFASSLFCDSAVTGTWMRDDAINPFTTAQTMQSGWCWQIDLPDKVNRGYVYSS

AFINDDDALQEMKRHNPLMSDRHSIVRFKSGRHQRFWVNNVVAVGNASGFVEPLESTGLHMIGETIKCVC

DVLIDSDQQPTPALINLANRAIAQKWDDIRDFLSIHFKFNHRVESEFWQHCWHQTDIGDAEAIVDFFQSN

GPSSLGQILLRPNSVFGYNGYLNLLMGQQVATKYQSHNDILDLDRWRQIQNYFTKQCANALSIHEAIQVV

KERKCQWLTS

114) Dsg117 from *Nostoc* sp. ‘Peltigera membr. cyanobiont’ 232 GenBank: WP_094340898.1
MIPKFHEACILEYRTILIDSFIHVEKTIHNVVVLGGGGGSAGFLSALALKVKMPWLNVVVVHSTNIPVIG

VGEATTAWIPWFLHKYLELNREQFYEETQPIWKLGIKFIWGDSTQSHFNYPFVTHLADKLSVLSKSTAYY

CLDSTTESSIYSLLMEQNKSPCFQRENGDFVVDERFGYHIENTSFVAYLERRAAELDIKIIDKAVVNIEV

AENGYVRQLKFTDETTLAGDLFVDCSGFRSTLLGETLQEPFCSFSSSLFCDSAVTGRWMRDDAIQPFTTA

QTMQSGWCWQIDLQDKVNRGYVYSSGFISDDDALQEMKCQNPLMGDEHNLIRFKSGRHQRFWVKNVVAVG

-continued

NASGFVEPLESTGLHMIGETIKCVCDVLIDSDQQPSPGLINLANLANRAIAQKWDDIRDFLSIHFKFNRR

VESKFWRHCWHKTDIGDAETVVDFFQNNGPSPIGQILLRKNSVFGYNGYLNLLMGQQVPTKYQSDNDTLD

LDNWRQVKNHFIKNCANALPIQEAIQVVKERKCQWLTS

115) Dsg118 from *Cellulophaga* sp. W5C GenBank: WP_077399145.1
MTIHFIEYEESKICQSIIKQLQEKYNFSCCLTKDLGCVKNNDLIIWFVQNENLESVLNTCANIRKHLPDT

TILFVSAFECDKILIGPIYSPNNTSGLDSALFFLYQEKCEDINSKLKLKLPLFKDILGEEFYIKRIHKLT

QKLAEKINEFKNVSQNKNSINKIEIYNIKESNFDERFVYPILEIKEDFYEKKKNSQLIQDINFINASKKD

FRFKLLNKSTLNKTVAIVGGGTAGYLSAISLKTKHPELEVTLIESEKIPIIGVGEATTPDLVDFLFKDLK

LDKLDFYKKVEPTWKLGIKFYWGESGDYTFNYPFGEHDLVSGYINGNIDHGSLTSILMSQDSSFILRKNE

KDFYSLTNPRRIGYAFHLENRKFVTYLKNKAIELGVVRLQNTIDKVILNDSHNQVSSLITSDGKKLQCDY

YLDCSGFKSLLIDKLDSQYFSYNDNLITDTAISFNVNHKGEIKPYTYAESMKNGWCWNIPLRDSDHRGYV

YSSKLSSENDIIDELKLKYPNLTDYKVIRFKSGRHNSFIKGNVAAIGNSYGFVEPLESTGIHMITEHIKI

LTKSFDALINDRTGTLKGHLNRHIANKWDYLKWFLSIHYKYNKKFDSPFWEFCRNEIDVSKYQHILDLYK

SDGPLQMLNNSLSDSLRFDFVDSLFGLKGVDNILLGQGVIPNSIDDIQNVGHELWKYNVNTWMNLSKRTI

PLKEDIEILVQNPNLI

116) Dsg119 from *Flavobacteriales* bacterium TMED113 GenBank: OUV52442.1
MKKVNKLVIVGGGTAGWITASWFSRRWGSKIDVTIIDKYQPERVGVGEATLLSFPSVMQKMGFRVEDWVK

RIDATFKAGILFPGWGREDKVIWHPFGFTSIGDNKVPMYDIWSNYQSKYDVKEISPLYRTAMGNKIELDY

IKDTYAYQIDCGKLVTFLHDNCNKICNYIQSDVKTVVKVDDDVEKIILEDGSEIKADLFIDCTGWNQLLI

GKEDNVDLSDRLFIDSALAARVKYENPDKEMHPYTDCQAMEHGWRWRIPTRSRIGTGYCFNKNITSPDEV

AKQFSEHWNGRIKPEDMRLLDWKPQMIDKFWKGNVVSIGLSAGFIEPLESTGLAMMIRGCEYLEESLYGC

IYNPVFEPDIYNIRMKASFETAVDYVNMHYSYSERKGKFWDYVRLSHEKSGMQILMENQILDPNNETLQT

DKISSFFGGTNWHIWLLQLMPEITKKTYWYPDTVDILSRFEKYIQTLDNNVKEATPQKILLKEWYG

117) Dsg120 from *Flavobacteriales* bacterium TMED113 GenBank: OUV52443.1
MKVKDIVIVGGGSSGWMAAAAISRCNDVKVTLVDKEVPTPLGVGEATLLSFEKFMVEQCGFNPNEFLGEL

DAGLKAGILFKDWGHKGNEIWLPFYWLNYPFTDPPVSMVDAWSTSQDIDFKKLEVLYQCSMDNIIDRTQI

GEGYAVHIDCIKLIKYIKEKISDRITYVNSSVKAYLGGNTLYLENGDKIEADLFVDCTGFKSILKRKRDR

VNLSDRLYVDTAVAGPIEYEDKHNEFRPYTTTTAVYDGWIWNTPLQSRIGTGLVFNRNITPIDQAKEYFC

SFWDQRTTPDKLKVIDWTPYYDTNQWEGKVVSIGLSAGFIEPLESTGLGLIIEGIKTLSKLLNDGFCNEY

DVNYYNNHMTLAYEQCVDYVNCHYSKSNIKSPFWDYVRDNYKMSEAQEVFLDEMSSENKTIMPGGKGFIF

GVGNWIHWLIQAGYPLEPRSWMKHDKMDESLNHLIECEDKKIELGTDLMGHNEFADKFL

118) Dsg121 from Chromatiales bacterium RIFOXYA1_GenBank: OGO75298.1
MVPYGYHLDAAMLARFLKRKATEAGVEHIEDTVTDVTVSDGNITAVTGVKASYSADVFIDSTGFRSLLIS

KLKADNWQSFSDALPCNKAVAIQRALPQGHSPNPYTVATALSNGWVWQIDLTSRQGTGYVYDGNRLSKEQ

AEQELRDYLGWHSDVIKCIHLDMNVGCRKEFWVGNCIAVGLAGGFIEPLESTGLHLINLGARLLGTHLMQ

PHPTQAVKDAYNKAMNGFYQDLKQFIVLHYCLSNRTDTEFWREAPAKAQLCEGLPEKLELWKHKICEYHD

LAGGYATTFVDENYRYILYGMQHYPALQYHSAETDKEVFARLQQLSDKAVEMTLPHVEFLQKIAAVR

119) Dsg122 from *Pseudogymnoascus* sp. 23342-1-I1 GenBank: OBT65220.1
MTVPTKCTVLVVGGGPAGSFAAAALARESYEVVLLEADKFPRYHIGESMLPSMRYFLKIIDFYGKFNEHG

FTRKNGAAFQFNRSQPEAYTDFIAADENGYAWNVVRSEADDMLFRHAGACGAHIFDETKVMAIQFAEVNG

LAAINGSNGHAEKKIGKPVSATWTRKDGTSGTVSFDYLIDASGRQGLLCTKYLKNRTINPNLKNIADWGY

WTGGAKFAPGTRMEGAPYFEALEDGTGWGWYIPLHNGTVLAKKKQMASPSSKDFYISWLGLAPEIKKLLV

HATLDGNIKSASDWSYHASTYAIPGARICGDAGCFIDPLFSSGVHLAVLGGLSAAVTIAAVKRGEVSEER

-continued

AMSWHSKKVTESYMRFFLVVSTGVKQIRSQDAPIIRDNDEVGFDRAFDIFKPVIQGRADADSTGTLSTED

IHKTIEYCFNALMHISPNNALIDKLKSVYDLGGNDEIKAKAITDLKKTPTVEESQELKYILGFVEDMFTI

DNFTLNSIDGLVPRTERGMLDLEVAHNAAYHRY

120) Dsg123 from SAR202 cluster bacterium Ae2-Chloro-G2 GenBank: PKB60447.1
MQKVSDVDILVIGGGPAGSTAASMAAKYGLSVKICEKSKFPREHVGESLLPASIPILEELGLGEKIKKAG

FLPKYGATMVWGRDKTPWSWRFSETNKQNTHSYQVSRPIFDEILLRRSEELGVSVEEEATIDKVNLEESN

RGAFVTSLNKGQYFQPANFIIDASGQSALIARSLKIREWDESFHNLAVYGYFSGATKLETPDENNIFIES

YQNGWVWSIPLADGTTSVGVVVDSKNASTQLQKTDPTAYLLSELSLSPKTSDMLLNSNLTTNAKVVKDWS

YTTSKMAGNGWALAGDAACFIDPLFSSGVHLAMMSGVLSSAYAVTYLKDRILGEESASVYETTFRQEYDH

FRDLALLFYSSNRTVDSYFWEARRLFKEENYFSDRTSFIRAVSGQSVRGYERVALERGELPNEFMSAINL

HNEESEKRNAHLLKIQNSIQMQVPTLSNEVKLEKKPVLSEGEFQWGTVITTPFRKEGVPCSNLVANLLMK

IDGKKSLIDIVDDLSRSASESAKEKLLKYSIDTISILYVEGVIDNLS

121) Dsg124 from *Talaromyces marneffei* ATCC 18224 GenBank: XP_002151004.1
MAIPEKTTVLVIGGGPAGSYCASALAREGIETVLLEAEKFPRYHVGESMLPSLRHYLRFIEADKKLDAHG

FIRKNGALFKLNSKPAAYTDFVGAGGPNGFSFNIIRSQADDLLFRHAGTSGAKIFDGVKVNSIEFVPSGL

PRSDDPDCEIPDPGRPVSASWVNKDTGDAGSIKFDYLVDASGRQGLVSTKYWKNRKMNTGAQLQSVATWG

YWTGGGIVEKGTSREGCPYFEAIADASGWTWYIPLHNGQWSVGVVMNQKVLADKKRAAGDGKNVYLQTIR

ETPGLQALLENGELVTELRSASDWSYNATAYSSPYLRVAGDAGCFIDPFFSSGVHLALTGGFSAATTICA

SIKGQTSEIGAAIWHTKKVSESYTRFLVIVSTALKQINEKDEPVISDFDEKTFERAFKHFRPIIQGTVDV

QGKLSQAEVSQALNFCFRAFHQVDSKEKQNLIEKMRSLAISDPDDLSNEKYSAALKELEAVLTPDQLHIL

QTIRARQMLRPEDMFTVETIGSDVIDGLSVNMVTGQLGLVHPGKAFKVAPSNKDILALLNGEELSESSIG

FKTDPGYQNPTAAAH

122) Dsg125 from *Aspergillus luchuensis* GenBank: OJZ87639.1
MTHAYCKYSECTVLVVGGGPGGSYAASVLAREGIDTVLLEADVFPRYHIGESMLPSLRHFLEFNGALPEF

EAHGFNMKKGAAFKFNSKPPGYTDFLKAGGHHNYTWNVLRSEADSILFHYAGECSCKTFDGVKVTSLEFR

ATEPSVNGNVGFPESASWTRRDKSTGSIQFEYLVDASGRAGLMSTKYLKNRRYNEGLKNTAIWGYFKNAA

TYGVGTSMKGSPYFSLLEDASGWTWAIPLHNRTTSVGVVQHQNSVKAKKQAMGSPSSKDYFLSCLHEVSG

IMDFIEGAELVSEVGSASDWSYNASSYAATNVRIIGDAGCFIDPLFSSGVHLALLGALSAAATICASMKG

QCSEQAAGEWHSEKVREACTRFLLVVSSAYAQMVHKDRPVLNELGENSFDRAFDIFRPIIQGTVDANGKI

AEKEVQESIEFCVRVLQKIDHEQSGVDTESARAGHIFQQDELENMKHIIMNSNETFTLDSFGADIIDGMT

ANIKRGSLGLEIVGDTCSHDNFL

123) Dsg126 from *Ophiocordyceps* sp. 'camponoti-saundersi GenBank: RDA92919.1
MSIPDTCTVLVVGGGPAGSFAAAALAREGIDVVALEMEKFPRYHIGESMLPSMRHFLQVIDFYDDFNARG

FTKKVVSPISLLVKKTSSACQRILAYQLTTCLPSRTARHSVSIRLNPMPVQLDFLAAGGPDSHAWNVIRS

EADEMLFKHAIASGARAFDDTKVDAIHFTNGVGGSEESKLGRPTSAAWTRGDGSSGTISFEYLVDASGRN

GILCKRYYKNRKVNDNLKNMAIWGYWKGSDTYGSPGTRSENMPYFETLQDASGWCWHIPLHDGTHSVGIV

LNQDLATKKKHELGSPQTKDFYLKSLQLVPRTSQLLSQAELVSDIKSASDWSYCASAYAFPYVRIIGDAG

CFIDPYFSSGVHLAVMGGLSAAVTISASIRRDCDEETAASWHSKKITESYNRFFMVVSYMAKIMFSKNEP

EIEGTYNEGVQNAFDILQPVLQGTTDANTSGNISLVEMFKMFKFILVALTGSSTEQVDDLVAKLEAPGFD

AETDPAVTEIVKSFQESLSIEESHVFDLLQNMRWYLQDYYTIDSFTLNPIDGLVTCMERGKLGLVSADKK

KAGKSLACRVESSARQACDEVN

-continued

124) Dsg127 from *Bacteroidetes* bacterium GenBank: PTM08497.1
MNKFYDAIIIGGGPAGSTMASKLAEKGQHVLVLEKAKFPREHVGESLLPFLYHLFEELGVLDEMKARFSR

KPGVTFSNIDGTEASHWCFKHVIKDESGLSFHVRRAEFDDMLLQNSRKKGAEVMEEVSVQKVDLDIDPNQ

ATVYAENAQGEQLQFTGRMVVDASGQNTILATQMKTKKPFESLTPRVAYSSHWENAKLTPELAAGNIKIV

HLEGEKMGWFWMIPLIDRLSVGVALNMSYANQQRRILKETTTDWQAKLYEQELQESLVAQEVLAGATRMG

PVMANGDFSYYSSTKWGTNFVIVGDASGFLDPIFSSGIYLGMKSSLLVAEGITDMLGGNGTATIETAYSD

IQGAYKLVEKLINTFYEPGSIKWDQAGSAFDLSYKKFETAYSILHLILAGDFFKNHAKYFKAIDILRTPQ

KIEQYKHLIGHDEPTMEQRVCIA

125) Dsg128 from Sorangium cellulosum So0157-2 GenBank: AGP37469.1
MQGHSVLLLEKEKFPRHQIGESLLPATTYGICGLLGIRDRIERAGFTRKQGGTFRWGKSPEPWTFRFAEN

PRVPGGYAFQVERSVFDKMLLDAAREKGVDVREEHAVVRVEQEDGRFSRVRFRDDRGSERTATAKYIVDS

EGHRGQTYALVGERVFSQFFQNVALYGYFLDGKRLPAPSSGNILCAAFRDGWFWYIPLSDRLTSVGAVVS

REAAQRIQDGPEQAFQSFVDSCPIIAEYLASATRVTEGVYGEFRVRKDYSYCNTRFWKPGLVLIGDAACF

IDPVFSSGVHLATYSALLAARSINSCLAGDIDEEEAFEEFEFRYRREFGNFYQFLLSFYDMHQEADSYFW

KARKVLNTDEKANDAFIRLVAGASSVDEPAFNHAEDFFRSRQGMGQWLEGMLSNQLAMQVDGLPGQSAPA

TLEGGPDAEQFMEGFTAEVRQIQTQAMFGHRRARESSVRPQGLIPSTDGFAWQRG

126) Dsg129 from *Acidobacteria* bacterium GenBank: PYV68218.1
MKMKTDVLIIGGGPGGATAAMLLIREGIKPIVLEQETFPRFHIGESMTGEAAQLLRRLGLEEKMLSANYP

VKHGVKVYGADGVNAWFIPVCARTPDWKLTPGTTWQVRRSHFDGMMLDEAAKRGANVIRGKAVKPLLGED

GSMRGVTMRRPDGSHEDIEAEVTLDCSGLATFLANQRVTGPKYVGNYDKQIAFFSHATGAVRGSASSGED

AKDNTLIFYLKKFHWAWFIPIDDEVVSLGLVVPTATFQESRQTPEEFFRSTLPGINPALARKVSDIQLVE

KVHVIPNYSYQVRRFCGKGFICIGDAHRFIDPIFSFGISATLREAEFAVPHVLAYLGGKGRDLANPFAEH

MLFCEKGTDNLEDMVDL

127) Dsg130 from Verrucomicrobia bacterium GenBank: PYK21723.1
MKMKTDVLIIGGGPGGATAAMLLIREGIKPIVLEQETFPRFHIGESMTGEAAQLLRRLGLEEKMLSANYP

VKHGVKVYGADGVNAWFIPVCARTPDWKLTPGTTWQVRRSHFDGMMLDEAAKRGANVIRGKAVKPLLGED

GSMRGVTMRRPDGSHEDIEAEVTLDCSGLATFLANQRVTGPKYVGNYDKQIAFFSHATGAVRGSASSGED

AKDNTLIFYLKKFHWAWFIPIDDEVVSLGLVVPTATFQESRQTPEEFFRSTLPGINPALARKVSDIQLVE

KVHVIPNYSYQVRRFCGKGFICIGDAHRFIDPIFSFGISATLREAEFAVPHVLAYLGGKGRDLANPFAEH

MLFCEKGTDNLEDMVDLFWEQPFAFATFVHHRYREQMIDAFAGRVYPSEQQPSPAILAFRKMLKRTRDYE

HEDDYSIPIGSRFHPERAAIWEPNSPLPATEEWMFAHSS

128) Dsg131 from *Penicillium nordicum* GenBank: KOS43943.1
MSIPTKATALVIGGGPGGSYAASALAREGVDTVLLEADVFPRYHIGESLVASIRPLLKFIDLDDTFVNYG

FVRKNGAAFKLNNQKEAYTDFILDPGAGTYAWNVIRSECDELMFKHAAKSGAKTFDGAKVTSIEFIPDET

NVESPGRPVSASWKTKDGRTGIIDFQYLVDASGRAGITSTKYLKNRTFNSYLKNVASWGYWRGATPYGVG

TPVEGQPYFEALQDGSGWVWFIPLHNGTTSVGVVMNQEMATKKKKVSSVTSSQAFYLESLEGARGISRLL

EPSTLEGDIKQASDWSYNASSYGSSHLRIVGDAGAFIDPYFSSGVHLALSSGLSAATSICASLRGDCEEE

AAWKWHSQGVANRYGRFLLVVLGATKQIRARDTPVMNKDGDEGFDDAFTVIRPVIQGIADVPGRTTHREI

LDAVAFSTNVVGPDIEGTEQAWVEKDHGALSCEEEEVGRVMNNLAKAYKAQDVYEGLTARLERGALGLQV

AN

129) Dsg132 from SAR202 cluster bacterium Io17-Chloro-G4 GenBank: PKB66002.1
MSQTASPYDVVVIGGGPGGSTAATMLARQGLRALLLERDHFPREHVGESLLPASIPVLEELGALPAIQQA

GFLQKWGATMVWGKDPEPWSWYFKETNPKYPHSYQVSRPEFDHILLDNSRQAGVEVREGYRATRVTFEGG

-continued

RAVGVRCESSTKEPLEIAAGFVVDASGQGGLLARQLGLRQWDPFFRNLAVYGYFQGAQRLPEPDETNIFI

ESYPQGWLWTIPLHTGLASVGAVVDSETGQEGIRRLGPRGFLMDQLSQGPATAEMLRKAELSSGPDVVRD

WSYVCKKTAGPGYVLVGDAACFVDPLFSSGVHLALMSGVLAAALVTSSLSDPDIEEAAGQVYQELYIQEY

NQFRELARLFYSSNLSSDSYFWEARRLTGKDAAFTPRQAFIRTVAGQPPRGYERAVLEHGDAPSEFISSV

GQVETDRARRQADLSAFLDPSGAMHHMFYSAVPSLAPGVTVVRKPVLGEGRFDWGNVIVTPSQPEGTPCS

ALVAEVASAIDGRTPVRGLMAKLQEDRDPSSAPIIEQTVVSAVQILYVDETISELISQ

130) Dsg133 from *Trichophyton soudanense* GenBank: EZF74478.1
MSIPASCTALVVGGGPAGSYAASALVREGVDVVLLEADVFPRYHIGESMLPSIRHFLRFIDLDSKFDSYG

FVQKNGAAFKLNSKPEAYTDFIAAGGPGSYAWNVIRSEADHLIFKHAGENGAKTLDGVKVNAINFEPLSE

ENSDPVSTDLGRPVSATWTRKADKSSGVIKFEYLVDATGRAGLVSTKYMKNRTYNQGLKNVAIWGYWKGA

SSYGIGTPREGDPYFEAIADGSGWVWLIPLHDGTTSIGVVMNQAMATTKKREAGSSSQQFYLDNVKQIPG

IWQLLDNAELVSDLKSASDWSYSASSYASPYLRIAGDAGCFIDPFFSSGVHLAFASGLSAALSIRAAQRG

DCDEMAAAEWHSKKVAEGYTRFLLVVMSALKQISDRDEPVLTDWDEESFNRAFDLFRPIIQGTVDVDKTL

TQAEIAQTINFCVNAFQNAGREEQDALMNKIKSVSETKNGEETDVVKKLKESLSADERRTLNTIQARQII

RSEDTMNIDNFTVDVIDGMVPNLKRGSLGLLRYVPKVKAGQQEDELRAKLGLPEKQESIFSY

131) Dsg134 from *Trichophyton violaceum* GenBank: OAL70258.1
MVGLVAIISVWWCVRPKPNKIPIIGDAKNQNFMAALEEGSRKQYPESCFRIPTRDIPTIIVPRKCLSTIA

YAPEHRLSLGREVYERLMGRYTKMVKSDHLAEFVRGGLSKQLGANISLLQEDAIWTISSQIGNCPEWKPL

QLFPAMVKLVPLHIGRTFINSPLSREQEWIDLTLEYAISTVTIAAKMSNTHWMLRPFKALFLPEIGEMSQ

QFKQASKLLSPVLNARLLGDAPGTKDLMQWMIDNYPGQSNNLTLHTRLQLEAVQAATYNLAFQLIHFFFD

ILAHPEYIEPLRIEIQTVFDSCGRTWTPAALAELRKCDSFLKESQRLNPIGIVSVSRFALSKFDLPDGTT

VPAGISVSAPAMTVNTDPSLWECPTQFDGYRFEKLRQIKGNEYKYQFSSISASELNWGYGTHSCPGRHFA

SNQVKVIIAELLMKYDFRFEENIQDNQTPKRPANNFDGVRIMPNPEARIMIRSREVGAICSVPEERDRGK

GDRIYRASNHSRVNGTNKSFNFTEEANMSIPASCTALVVGGGPAGSYAASALVREGVDVVLLEADVFPRY

HIGESMLPSIRHFLRFIDLDSKFDSYGFVQKNGAAFKLNSKPEAYTDFVAAGGPGSYAWNVIRSEADHLI

FKHAGENGAKTFDGVKVNAINFEPLSEENSDPVSTDLGRPVSATWTRKADKSSGVIKFEYLVDATGRAGL

VSTKYMKNRTYNQGLKNVATWGYWKGASSYGIGTPREGDPYFEAIADGSGWVWLIPLHDGTTSIGVVMNQ

AMATTKKREAGSSSQQFYLDNVKQIPGIWQLLDNAELVSDLKSASDWSYSASSYASPYLRIAGDAGCFID

PFFSSGVHLAFASGLSAALSIRAAQRGDCDEMAAAEWHSKKVAEGYTRFLLVVMSALKQISDRDEPVLTD

WDEESFNRAFDLFRPIIQGTVDVDKTLTQAEIAQTINFCVNAFQNAGREEQDALMNKIKSVSETKNGEET

DVVKKLKESLSADERRTLNTIQARQIIRSEDTMNIDNFTVDVIDGMVPNLKRGSLGLLRYVPKVKAGQQE

DELRAKLGLPEKQESIFSY

132) Dsg135 from *Agaricus bisporus* var. bisporus H97 GenBank: XP_006454183.1
MPNAQLPSRTTVLVIGGGPAGAYAASALARENIDTIVIEAAKFPRYHIGESMLPSLNSFMRFIGAEEKLR

DHGFTTKLGAAVKFNQHKKEGYTDFTRGDVRNASCNVIRSEFDNMLLRHAEESGARVFEETKITDIEFET

NGAEMRPTSATYTRKNGEVGVVHFDYLVDASGRNGIVSTKYLKNRKMNQSLHNLACWGYWTGQKQYMPNS

SRHNAPWFESLTDESGWAWFIPLHNGTVSVGIVMDSSISAQKKAEGRKATSDGNYTLRDHYLDQIQLVPG

LKAFLEEATLKEDGEHYVIRSAADYSYAADKYAGDHYRIIGDASAFIDPFFSSGVHLALLGGLTAAASIA

ASIKKQCAEEVAWKFHDVKVATAYTRFLLVVMSAYKQIRNQSVAVLSDVDEDNFDRVFDIFRPVIQGNSD

VGKNLSENELERTIDFCKDIFAPTDPEMIEAVGARLRPELLAANSPILTNEEINIESQGDDEARIVLHRL

NARKPVNQMYQGPDNLQVGDVGGYVAHIQVGALGLVEVAST

-continued

133) Dsg136 from *Coprinopsis cinerea* okayama GenBank: XP_001838319.1
MGRTSPSSLRTQVLVIGGGPAGAYAASVLAREGFQTTVLEATKFPRYHIGESMLPSVTSFFEFIGLDEKL

RNHGFCSKPGAAVKFNQRKKEGYTDFLKNNSEGTWNVVRSEFDEMLLRHAGESGATVLEEHKVIEIKFED

VSGKSRPYSAVFTRPSGERSEIHFDYLIDASGRNGIMSTKYLRNRKMNSSLHNIACWGYWEGGYGKYMPG

TRRENAPWFEALTDESGWAWYIPLHNGTVSVGVVMDQDVSSSKKAKAREASATGEHTLCDHYLQQLELVP

GLKALLGTATLVSNHVKSASDYSYSAERYAGDRFRIIGDASAFIDPLFSSGVHLALLGGLTAASTVAASV

RGHCSEEEAAEYHHVKIGAAYTRFFLVVMSAYRQIRSQNVDILSDVDEDNFDRAFDIIRPVIQGTADVGR

TLSESELQKTLDFCKDVWAPVDPEMHERVASRYGSELLSPAAPIFKPEDLDQIVDPNDEDAVDVFKRANA

RKIVDPMFKGISSLESEPVKGFITCLQRGSLGLIYIASAA

134) Dsg137 from *Melittangium boletus* GenBank: WP_095982085.1
MLNIPASTKVLVLGGGPAGSTAASFLARAGVEVTLIEREMFPRYHIGESLLPSCLEIADLIGARQKIEAK

GFVKKPGAYLEWGREKWSLDFGELQGQHTYSFQVDRSEFDELLLRHSEEQGVRVFEGVEVKSIENNAEGR

PVKAVWAVHGDESQTGEISFDYLIDASGRHGVMSTRYLRNRQFHKVFQNIAVWGYWEGTQKGADYRDGAI

AVGSIPDGWIWAIPMSGGKTSVGVVVHKDSFQAQKREADTAKIYEDAIASCPLIQRVCSGAKLVTGLKTE

SDYSYAAESFCGPGYFLCGDAACFLDPLLSTGVHLAMLSAMLSAAAITSVVSGEVSEQEAQSFFEKSYRQ

AYLRFLVFVSVFYDQRCGKDNYFKEAERLSQYEKDPSRLKQAFLNLVSGLEDLSSAEQATSHLIGEMSRR

VTENLTLRKDKSTLASGSEEIKGRAQDNARFFDGVEGIPVMTPEGAIDGLYVVLKPRFGLGRFVATVEAS

SIVNVKKEEVRL

135) Dsg138 from *Halobellus rufus* GenBank: WP_049984930.1
MAGSTISMILAKNDLDVLLIEAKKHPRFAIGEAMLPLSAVWMWIVGEYFDVPEIQHLSDANRIVDNVTES

CGVKHSVGFAYHERGQPFSGEHAHQLVPPEMPFYKESHLLREHVDHYLVESAGSYGVEYVDETPITDVEI

DDDEVTVTTDRGTTTGAVFVDATGGNSILAEKRGYRDETPDLETDTRAIFAHVEGLEPFDELIDEEDRPG

QTNRLHDGTLHHVFEGGWLWVIPFDNFDRSTETKASVGLMLDRNTRPRDESLSAEEEFHEIISAYPDVER

HLGPVEPVMPWIRTGRLQRSASESSGHRHLLTNHTYGFVDPLYSQGMVHTFESVFQSAKLLLEAFEVGDF

SAERFAPIDDLHRRQLETADLLVSNAYTSMDEFDLWNAWTQLILVESVFPDLYIQRHCLKYLSSGDPAEL

DRLLRETRPGDDAPFAPEKDALLDRSSAVLDAYTAGEISAGTAAESLFDAMKRADWLPRSVYDWGNEDER

HIDFADPAVTGELLAWGRTDAPAHIREGLFDFEMPEMP

136) Dsg139 from *Chromohalobacter japonicus* GenBank: WP_075368400.1
MHTEASLQAADCDVAIIGAGPAGAAAAARLSRLGWRVHVIERSHFPRFSIGESLLPQSMAYLEAAGLLET

VQAGGYQPKNGAAFTRHARTTTIDFREKSTPGWGTTYQVPRADFDQRLIHAAEAQGATLEFGTTVTAFNA

DAARPVLQLEDEQGTTRHLSARFVLDASGYGRVLARLEALERDPRAEPRMAIFSHVEDGIEDADYDREKI

LIGVHPEDAGIWYWLIPFADGRASVGVVGDIETLTAHGDSPEARWQALLDQEPRFRQLLHQARRVREVNE

IRGYAASVTRLHGPGYALLGNAGEFLDPVFSSGVTIALHSAHLAAPLIDRQLHGEKIDWHADFETPLRAG

VDTFRAFVEAWYAGTLQTIVFHEAPPPRFKRWISGVLAGYAWDRDNPFVTASRRRLATLAEVCAQRDEVR

S

137) Dsg140 from *Photobacterium leiognathi* GenBank: WP_060988050.1
MLNNRQRTQVAIIGAGPSGAVAAALLNQHKVDVVVLEKNTFPRFSIGESLLPACMEVIKKANMVDAVNAA

DFQYKNGAAFRRRDTYTAFDFRDKFTDGAGTTFQVQRGNFDKVLADEAAKQGVEIRYQHNVEAVDCGDST

SVLTVRDEVSDQVYQLEADFILDASGFGRVLPRLLDLEQPSCLPVRHAIFTHVVDHIEDSGVEHDREKIL

ISVHPTNEDVWFWLIPFSNGTCSLGVVAEPAFLAQYDADEKTALQQIVAEEPTLNKLLSKAEYSNPAAQI

GGYSANVKNLATNNYALLGNAGEFLDPVFSSGVTIAMQSADFAVNALLKQLAGDEVNWQQDYADKLMVGV

NTFRTYVEGWYSGELQKVIFYTDPEPKIKQMVCSILAGYAWDQNNPFVAQSERRLRTLAEICS

138) Dsg141 from *Halomonas titanicae* GenBank: WP_083868842.1
MATGAAKQMKTHDTTDVAIIGAGPSGAAAAAWLARRGINVRVIERQRFPRFSIGESLLPQCMVHLEACGL

LDAVQTGDFQFKNGAAFTWRDRYAAIDFRDKFSPGPGTTWQVERADFDQRLIDGARQAGASVEFETQVEA

FVADHDRPSLTLVDANGEQRSLQARFVLDASGYGRVLARLTGLARPSTLESRCALFTHIEDRIDCSHYDR

DKILIGLHPEHSGIWYWLIPFSQGRASVGVVGDRATLEAAGVDDKERLWHFLHAEPRLNKLLVNAKAIRD

IGRLEGYSADVEQLHGPGFALLGNAGEFLDPVFSSGVTIALDSALRAAPLVERQLAGEKIDWDSQFEQPL

RRGIATFREFVDAWYDGRLPRIIFNDQQIPRIREMISSVLAGYAWDEENPFVAASRRRLHSLAEACSDIS

SHATGEG

139) Dsg142 from *Myxococcus xanthus* GenBank: SDW40578.1
MSGAWEGKLYDVIVMGGGPAGATLAARLRKDPGLSVAIFESERFPREHIGESFVPSAVSSLQESGALGRV

LSSDCWIKKGGGYYSWDAVRPWSTFFEHKAYERDGYRRWAFHANRAELDDILLRHAEENGAEVFEGTPVK

QVYRRDGFTEVDLGEKGSARCKVFVNASGRYSVTSLGGPREFLSSYRNIAIWSYIRKGKPAQSLPGDWNI

FRESGVSPIGSFAFEDGWFWYIPIPLEVDGRREVVHSLGLVTDPRGLKSKRDYMSPSVFMETARKVPFLC

DLVADAELIYDEFRTTANYSRISHQMCSWENREIRVGDAAFFVDPLFSTGVHFALHHTAAAAVLVRAAFD

EAMPEQHREDLWHDYDQMLRKQAQVFSLAIDQWYNEISLAHPGSVYWRERSERATFEVRNATFHYLVNGS

LDEDLLHVISQGNDAVEALSETGAWRTSFAQLQRLRPADDALVQLMPNVKFRQSVTLEHPIADSAEDKLD

ARPQAFDHGPYWESPERHAHEVAPRFGRPSPCLRFYFEDGDHQDTVRILWNRPNSALLERLSQPHAYGPL

LAGCSLSERGLLDQLLLKGMMRVIP

140) Dsg143 from *Pseudoalteromonas phenolica* GenBank: WP_058028750.1
MDQFKSYDVVIIGSGPAGSLCGIECRKKGLSVLCIEKDEFPRFHIGESLTGNAGQIIRDLGLADEMNAAG

FPDKPGVNVIGSLSKNEFFIPILAPTWQVRRSDFDNMLKRRALEHGVEYQQGLVKDVIKHEEKVVGAIYK

ADGVEHQVRSKVLVDASGQNTFLSRKGIAGKREIEFFSQQIASFAHYKNVERDLPPFSTNTTILYSKQYH

WSWIIPISPDTDSLGIVIPKDLYYKECKNPDDAIEWGMEHISPEIRRRFKNAERVGESQSMADFSYRIEP

FVGDGWLCIGDAHRFLDPIFSYGVSFAMKEGIKAADAIKRAIDGNDWKTPFYEYRDWSNGGQQIAADLIR

YFWIYPIFFGYQMQNPDLRDEVIRLLGGCCFDCEGWKAPTIFRNAIEEYDRKQMAG

141) Dsg144 from *Acinetobacter baumannii* GenBank: SCZ10544.1
MGDYDFDVGIIGGGPAGSTMASYLAKAGISCAVFEKELFEREHVGESLVPATTPVLLDIGVMDKIEKANF

PRKFGAAWTSADSGPEDKMGFQGLDHDFRAAEILFNERQQEGVDRDFTFHVDRGKFDRILLEHAGSLGAK

VFQGVEVADVDFVKPGDVRLNVKLGNQKVGIRTRMVVDASGRHVLLGRRLGLREKDPVFNQFAIHAWFDN

FDRRSATRNPDKVDYIFIHFLPLTNTWVWQIPITETITSIGVVTQKQNYTKSGLSYDDFFWEAVKTRENL

YDALKASEQVRPFKKEADYSYGMKEVCGDSFVLVGDAARFVDPIFSSGVSVALNSARIASKDIIAAVRNN

DFGKASFAEYEGMIRNGIKNWYEFITLYYRLNILFTAFVQDPRYRLDVLQLLQGDVYSGERLKVLDKMHE

IVATVESDPDHLWHKYLGDMQVPTAEPAF

142) Dsg145 from *Serratia* sp. S4 GenBank: WP_017891342.1
MTQNSPANGRDSNHFDVIILGSGMSGTQMGAILAKQQFRVLIIEESSHPRFTIGESSIPETSLMNRIIAD

RYGIPELDHITSFYSTQRYVSSSTGIKRNFGFVFHKPGQEHNPKEFTQCVIPELPWGPESHYYRQDVDAY

LLQAAIKYGCTVRQKTKVTEYHADKDGVAVSTAEDERFTGRYMIDCGGPRAPLATKFNLREEPCRFKTHS

RSLYTHMLGVKPFDDIFKVKGQRWRWHEGTLHHMFEGGWLWVIPFNNHPKSTNNLVSVGLQLDPRVYPKT

DISAQQEFDEFLARFPSIGAQFRDAVPVRDWVKTDRLQFSSSTCIGDRYCLMLHANGFIDPLFSRGLENT

AVTIHALAARLIKALRDDDFSPDRFEYIERLQQKLLDHNDDFVSCCYTAFTDFRLWDAFHRLWAVGTILG

QFRLVQAHARFRASRDEGDLDNLDNDPPYLGYLCADMEGYYQLFNDAKAEIEAVSAGLKPTGEAAARIHA

LIDERDFAKQMFGFGYCITGDKPQLNNSKYSLLPAMKLMHWTQTSAPAEVKKYFDYNPMFALLKAYITTR

ISLSRKK

-continued

143) Dsg146 from *Saccharopolyspora erythraea* GenBank: WP_011874512.1
MNTQRHSNDKTPYDVAILGTGIGGSMLGAILARHGAKVLLIDAGQHPRFAIGESTIPYTLLTLRILADRY

DVPEIKALATFTDTSRTIGNTFGVKKHFGFLLHHENEPQDPREVSQFNTPGLLHEAAHLHRQDTDAYLFH

VAIRYGCTARQNCRVAEVEFDDSGVTLETVNGEQFRTRYVVDASGFRSPLAEKFGLREDPCRFKHHSRSL

WNHMLDVTPTDKVLDRPREHRPPVPWYEGTVHHMFERGWFWVIAFDNNKLSSNPLCSVGLTLDERRYPKP

TDISPEEDFYRHAARFPDVARQYEGAKPAREWVSTPRLQYSSSHTVGDRWCLLAHAAGFIDPLFSRGLSN

TAEAVNSLSWRLIRAVKDDDFSAERFEYVDRLQQRLLDHNDELVNAAFISWCDYDLWTAVFRAWASGTNA

GSYRLSKAITEFAKDGRDEHFMALEEPPHLGLYWPDHDGFAKFFESMVSQCDLVEQDMLSPRQAADNIYT

QLREADFVPKHFGFAERGQRFINPTPMRFIKTVRWAMREGDPKLRGLIINNAKEALKARVKGQKLY

144) Dsg147 from *Enhygromyxa salina* GenBank: KIG13408.1
MTSSTQDVIIIGGGPGGSALGSYLSKAGISNTIFESAIHPRPHVGESLVTSTTRIFQDIGFLETMEREGF

VRKYGASWHPIKRNAELTIEFAEFPQEGIEQDYTYHVDRARFDALLLKHASELGSTVYQGTEVKQVLMEG

DRACGVRVAVAGQTIDVPAKLVVDASGRRAVLGRQLKLLEKDPQFDQFATHAWFENVARSATGRLHDIHI

YFLPVERGWVWQIPITETITSVGVVVEKRDFVQNKGEIEAWFHEMLCSTPDGAVAMQDAVRINEFKREGD

YSYRMSRFTGPGYLMIGDAARFVDPIFSSGVSVATYSAKFASEAIHRVLRGGEDEATAFDDYATTLGAGC

SIWYEFICLYYRLLPLFTLFIQNDDYRMQILRLLQGEVFQREEVTVLDAMRRFISAVEANDEHLMRPYLG

DVDLSVVDELRVPTRAP

145) Dsg148 from Verrucomicrobia bacterium TME56 GenBank: OUU36477.1
MNSITIVGGGTAGLITALILKKRLDVKIQAIVPSNIGIIGVGEGSTEHFDDFRQHLHLDVKDVLRETKGT

LKSGIMFEDWTNKHSRYLHHIHSMWNIKLGLSARNYEYLMINNKGASCFAPMTLFHNEVGLEPSDRLVQY

HFNTFKLNEYLIKLCKENNINIIDDEIVDVNLNDKGIKELKGKKKTYKSSFYIDCTGFKKLLISKLGAKW

QSYSKYLKTNSAIAFPTGDQEDYNIWTLAKAMKYGWMWQIPTYGRTGNGYVYSDQYTNKEEAKKEIEKLL

GKEIEIAKHIKYDPGALDKPWIKNCVAVGLCANFVEPLEATSIGTTIQQAFLLMQYLENYNQQSINIYNK

QVSTVMENVRDFIQLHYINDKKTTNFWKDVNKVEPSDTLKQYMHVWKSGRLLKSTDMESIGHYNLFTLFK

EDNFNLIAYFNGLIDTKLLRNSYNIVNKNLKRYWLENRIEGDMLWRNTDRTRKMSHKKYIQEIHDKN

The 145 sequences listed above (numbered 1-145) have been allocated the SEQ ID NOS identified in the table below.

| Sequence number | SEQ ID NO | Sequence number | SEQ ID NO | Sequence number | SEQ ID NO | Sequence number | SEQ ID NO |
|---|---|---|---|---|---|---|---|
| 1 | 5 | 26 | 30 | 51 | 55 | 76 | 80 |
| 2 | 6 | 27 | 31 | 52 | 56 | 77 | 81 |
| 3 | 7 | 28 | 32 | 53 | 57 | 78 | 82 |
| 4 | 8 | 29 | 33 | 54 | 58 | 79 | 83 |
| 5 | 9 | 30 | 34 | 55 | 59 | 80 | 84 |
| 6 | 10 | 31 | 35 | 56 | 60 | 81 | 85 |
| 7 | 11 | 32 | 36 | 57 | 61 | 82 | 86 |
| 8 | 12 | 33 | 37 | 58 | 62 | 83 | 87 |
| 9 | 13 | 34 | 38 | 59 | 63 | 84 | 88 |
| 10 | 14 | 35 | 39 | 60 | 64 | 85 | 89 |
| 11 | 15 | 36 | 40 | 61 | 65 | 86 | 90 |
| 12 | 16 | 37 | 41 | 62 | 66 | 87 | 91 |
| 13 | 17 | 38 | 42 | 63 | 67 | 88 | 92 |
| 14 | 18 | 39 | 43 | 64 | 68 | 89 | 93 |
| 15 | 19 | 40 | 44 | 65 | 69 | 90 | 94 |
| 16 | 20 | 41 | 45 | 66 | 70 | 91 | 95 |
| 17 | 21 | 42 | 46 | 67 | 71 | 92 | 96 |
| 18 | 22 | 43 | 47 | 68 | 72 | 93 | 97 |
| 19 | 23 | 44 | 48 | 69 | 73 | 94 | 98 |
| 20 | 24 | 45 | 49 | 70 | 74 | 95 | 99 |
| 21 | 25 | 46 | 50 | 71 | 75 | 96 | 100 |
| 22 | 26 | 47 | 51 | 72 | 76 | 97 | 101 |
| 23 | 27 | 48 | 52 | 73 | 77 | 98 | 102 |
| 24 | 28 | 49 | 53 | 74 | 78 | 99 | 103 |
| 25 | 29 | 50 | 54 | 75 | 79 | 100 | 104 |
| 101 | 105 | 112 | 116 | 123 | 127 | 134 | 138 |
| 102 | 106 | 113 | 118 | 124 | 128 | 135 | 139 |
| 103 | 107 | 114 | 118 | 125 | 129 | 136 | 140 |
| 104 | 108 | 115 | 119 | 126 | 130 | 137 | 141 |
| 105 | 109 | 116 | 120 | 127 | 131 | 138 | 142 |
| 106 | 110 | 117 | 121 | 128 | 132 | 139 | 143 |
| 107 | 111 | 118 | 122 | 129 | 133 | 140 | 144 |
| 108 | 112 | 119 | 123 | 130 | 134 | 141 | 145 |
| 109 | 113 | 120 | 124 | 131 | 135 | 142 | 146 |
| 110 | 114 | 121 | 125 | 132 | 136 | 143 | 147 |
| 111 | 115 | 122 | 126 | 133 | 137 | 144 | 148 |
| 145 | 149 | | | | | | |

Thus the disclosure provides the halogenases encoded (or provided) by each of SEQ ID NOS: 5-149.

Further, the disclosure relates to nucleic acid sequences encoding any of SEQ ID NOS: 5-149.

The disclosure relates to functional variants, derivatives, portions or fragments of any of the sequences disclosed herein as SEQ ID NOS: 5-149. One of skill will understand that the term "functional" relates to the halogenating activity of any of the full or complete halogenases described herein. Thus a functional variant, derivative, fragment or portion, is any variant, derivative, fragment or portion that exhibits halogenase activity (in other words, a variant, derivative, fragment or portion of any of the sequences described herein, which variant, derivative, fragment or portion exhibits an ability to promote, catalyse or stimulate a halogenation process). A halogenation process may be characterised by the addition of a halogen moiety to another compound or molecule.

The terms variant or derivative may embrace any sequence which, relative to any one of the sequences provided by SEQ ID NOS: 5-149 herein, may contain one or more amino acid mutations. The term "mutation" may include any alteration to any of the wild-type halogenase sequences disclosed herein. For example, the term "mutation" may embrace:

(i) one or more amino acid substitution(s) (where one or more of the wild type amino acid(s) is/are swapped or changed for another (different) amino acid—the term "substitutions" would include conservative amino acid substitutions); and/or (ii) one or more amino acid deletion(s) (where one or more of the wild type amino acid residue(s) are removed); and/or (iii) one or more amino acid addition(s)/insertion(s) (where additional amino acid residue(s) are added to a wild type (or reference) primary sequence); and/or (iv) one or more amino acid/sequence inversions (usually where two or more consecutive amino acids in a primary sequence are reversed; and/or (v) one or more amino acid/sequence duplications (where an amino acid or a part of the primary amino acid sequence (for example a stretch of 5-10 amino acids) is repeated).

Note, in points (i)-(v) above, the term "wild type" may relate to each of the amino acid sequences presented as SEQ ID NOS: 5-149 above.

As stated, a variant or derivative sequence comprising one or more mutation(s) should be functional.

The terms "fragment" and/or "portion" may embrace (halogenating) fragments or portions of any of the halogenase sequences disclosed herein-including, for example those provided as SEQ ID NOS: 5-149 an/or variant or derivative (and functional) sequences thereof.

For example, a fragment may comprise from about 5 (or fewer) to anywhere up to (n−1) residues of the same sequence (where "n" refers to the total number of amino acid residues). In most cases, a useful fragment or portion will contain one, more or all of the motifs identified as SEQ ID NOS: 1a/b, 2 and 3 above. Thus, fragments or portions for use may contain, for example about 10, about 15, about 20, about 25, about 30, about 35, about 40, about 45, about 50, about 60, about 70, about 80, about 100, about 150, about 200, about 250, about 300, about 350, about 400, about 450 or about 500 residues (for example continuous or contiguous residues) from any of the halogenase sequences given as SEQ ID NOS: 5-149.

The terms "variant", "derivative", "fragment" and/or "portion" may also apply to nucleic acid sequences encoding any of variant, derivative, fragmented or portioned halogenase sequences described herein. In each case, a nucleic acid sequence of this disclosure may encode a functional halogenase (e.g. a halogenase provided by any of SEQ ID NOS: 45-149) variant, derivative, fragment or portion.

It should be noted that Dsg407 (SEQ ID NO: 6: halogenase from Cyanophage Syn10 GenBank: AGH56623.1) has been identified as a flavin dependent halogenase enzyme which iodinates substrates (i.e. it is capable of incorporating iodine). Indeed, the data shows that this particular halogenase is capable of regioselective halogenation of a diverse range of substrates (including chlorination and bromination of such substrates), with a preference for forming highly reactive aryl iodine species (in other words it exhibits a preference for catalysing iodination type reactions). This is an important finding as an FDH iodinase has yet to be identified. While the variant B brominase Bmp2 and the decarboxylating phenol brominase Bmp5 may be thought to utilise iodine in vivo, this activity has not been demonstrated in vitro.

The disclosure also provides a method of halogenating a substrate, said method comprising contacting a substrate to be halogenated with one or more of the halogenases identified herein. For example, a method of halogenating a substrate may comprise contacting a substrate to be halogenated with one or more of the halogenases encoded by SEQ ID NOS: 5-149 above.

DETAILED DESCRIPTION

Figure 1:
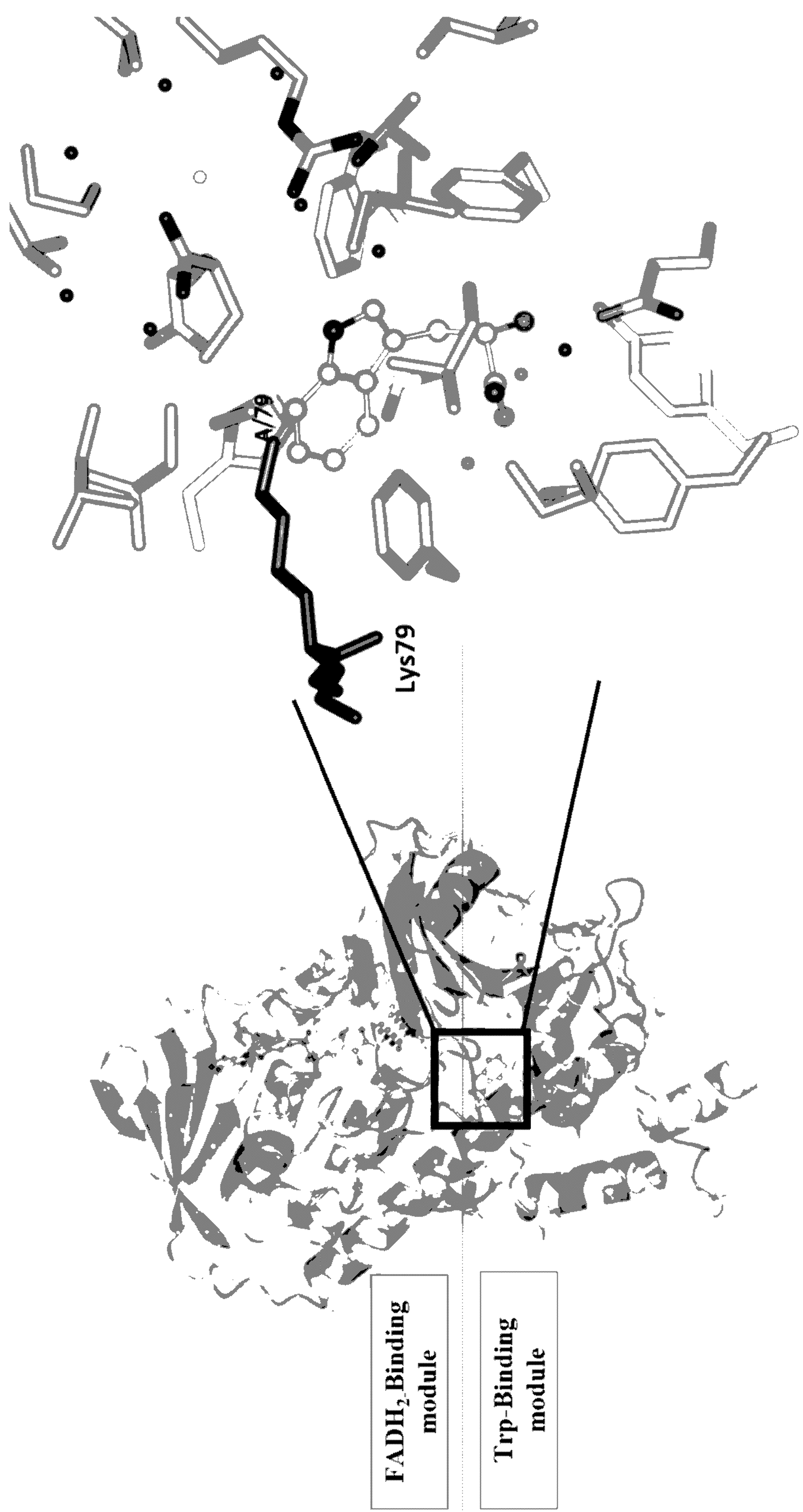

The present invention will now be described in detail with reference to the following Figures which show:

FIG. 1: Overall structure and active site of the tryptophan-7-halogenase PrnA highlighting the conserved lysine residue (magenta) and the tryptophan substrate (green). Image obtained using structural and surface analysis (with CCP4MG molecular graphics software) to structural data of crystalline structure of PrnA obtained by Naismith et al (Science, 2005), deposited on PDB as 2aqj.

Figures 2A, 2B:
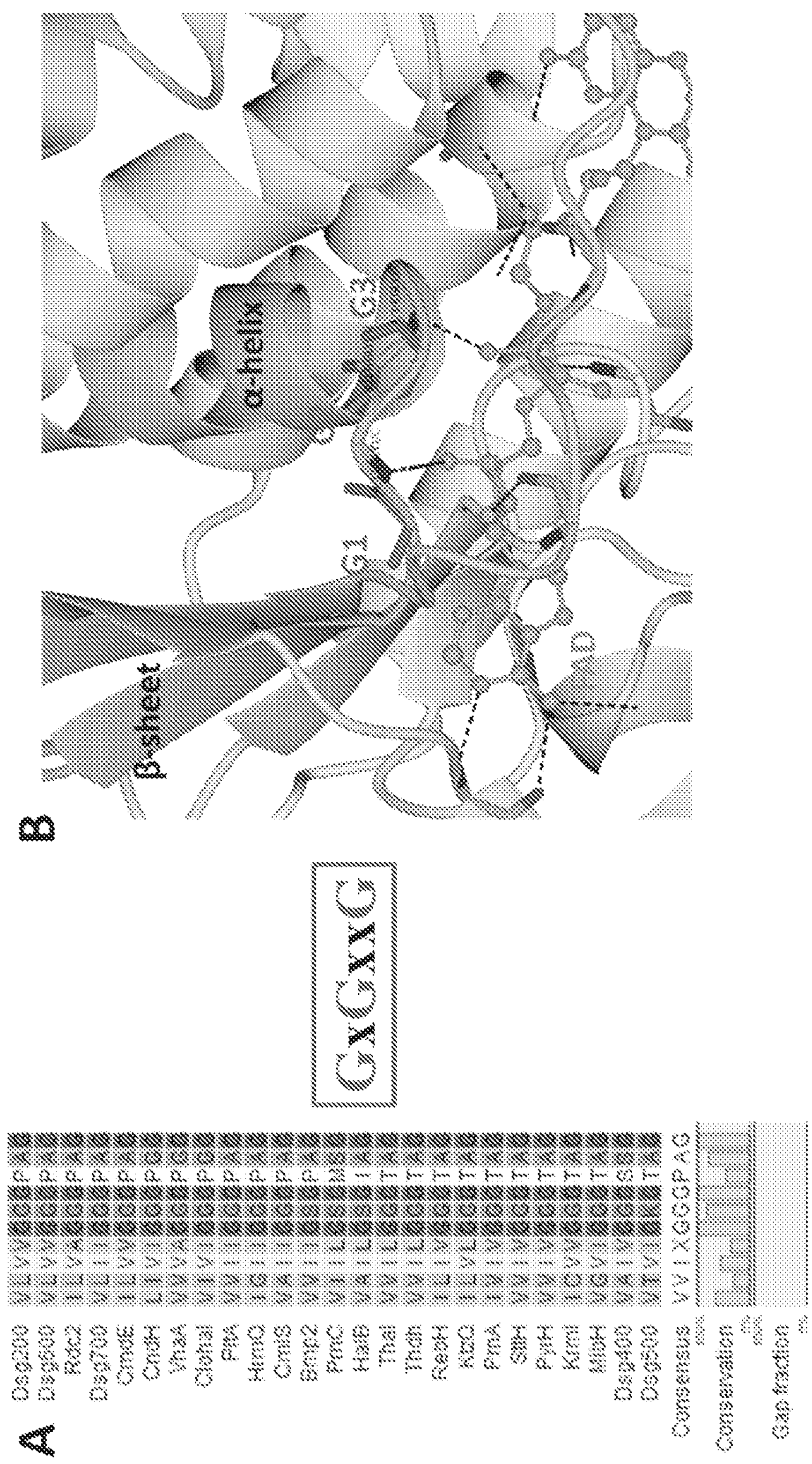

FIGS. 2A and 2B: Conserved dinucleotide motif, part of Rossmann fold. Common within FAD and NAD(P)H-dependent enzymes. FIG. 2A) part of the $MSA_1$ is shown, with sequence conservation ranging from blue (0% conservation) to red (100% conservation); SEQ ID NOs: 155-177 are shown in the figure. FIG. 2B) The binding pocket of FAD (orange) in PrnA is shown, with the three glycine residues (pink) highlighted, showing their position relative to the β-sheet (purple) and α-helix. Image obtained using structural and surface analysis (with CCP4MG molecular graphics software) to structural data of crystalline structure of PrnA obtained by Naismith et al (*Science,* 2005), deposited on PDB as 2aqj.

Figures 3A, 3B:
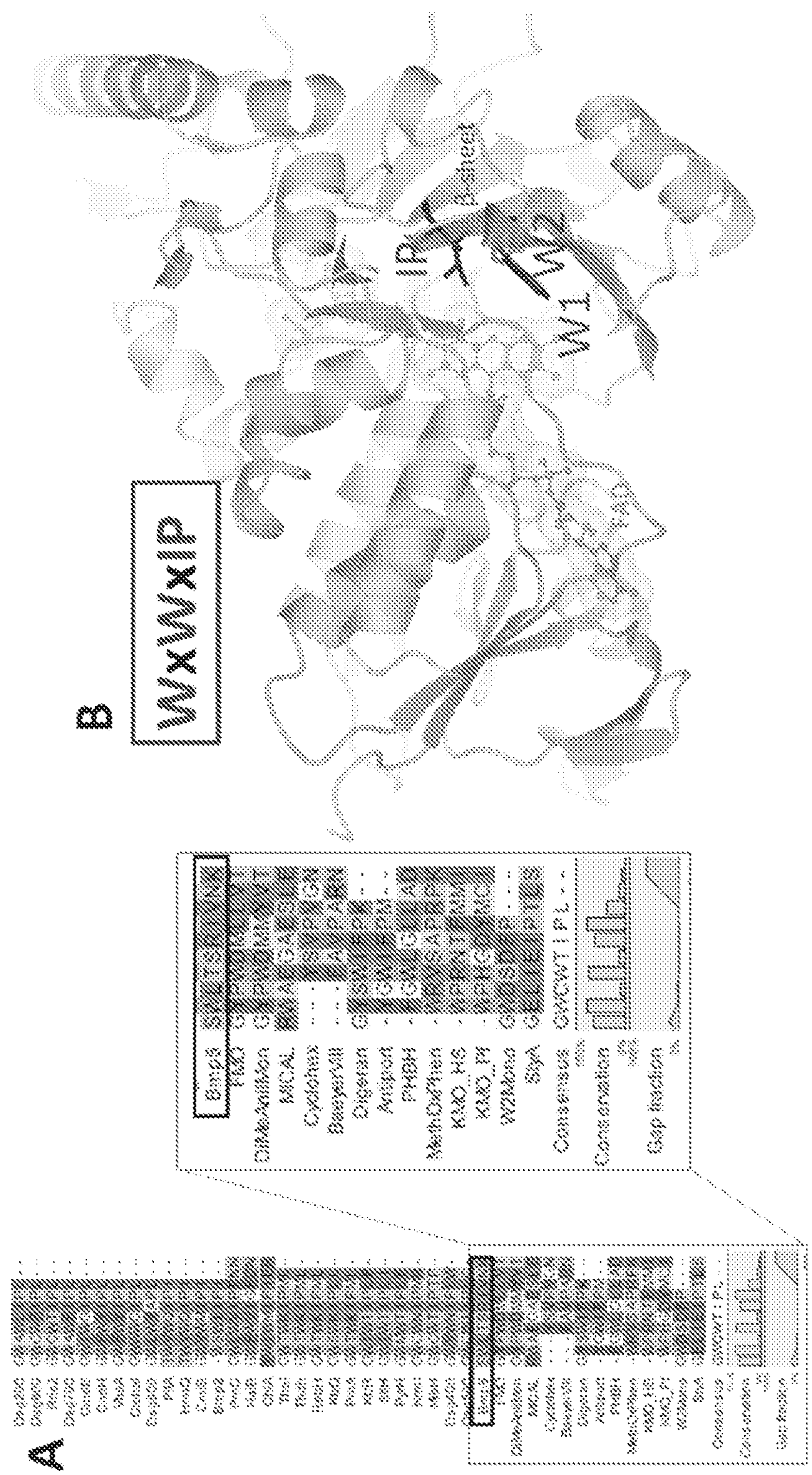

FIGS. 3A and 3B: FIG. 3A) On the left, the $MSA_2$ is shown, next to the zoomed area of non FDH motifs. Highlighted is the single component FDH, Bmp5. SEQ ID NOs: 178-215 are shown in the figure. FIG. 3B) the two tryptophans and IP residues are highlighted (in blue) relative to the β-sheet that they participate and the overall structure of PrnA. Image obtained using structural and surface analysis (with CCP4MG molecular graphics software) to structural data of crystalline structure of PrnA obtained by Naismith et al (*Science,* 2005), deposited on PDB as 2aqj.

Figure 4:
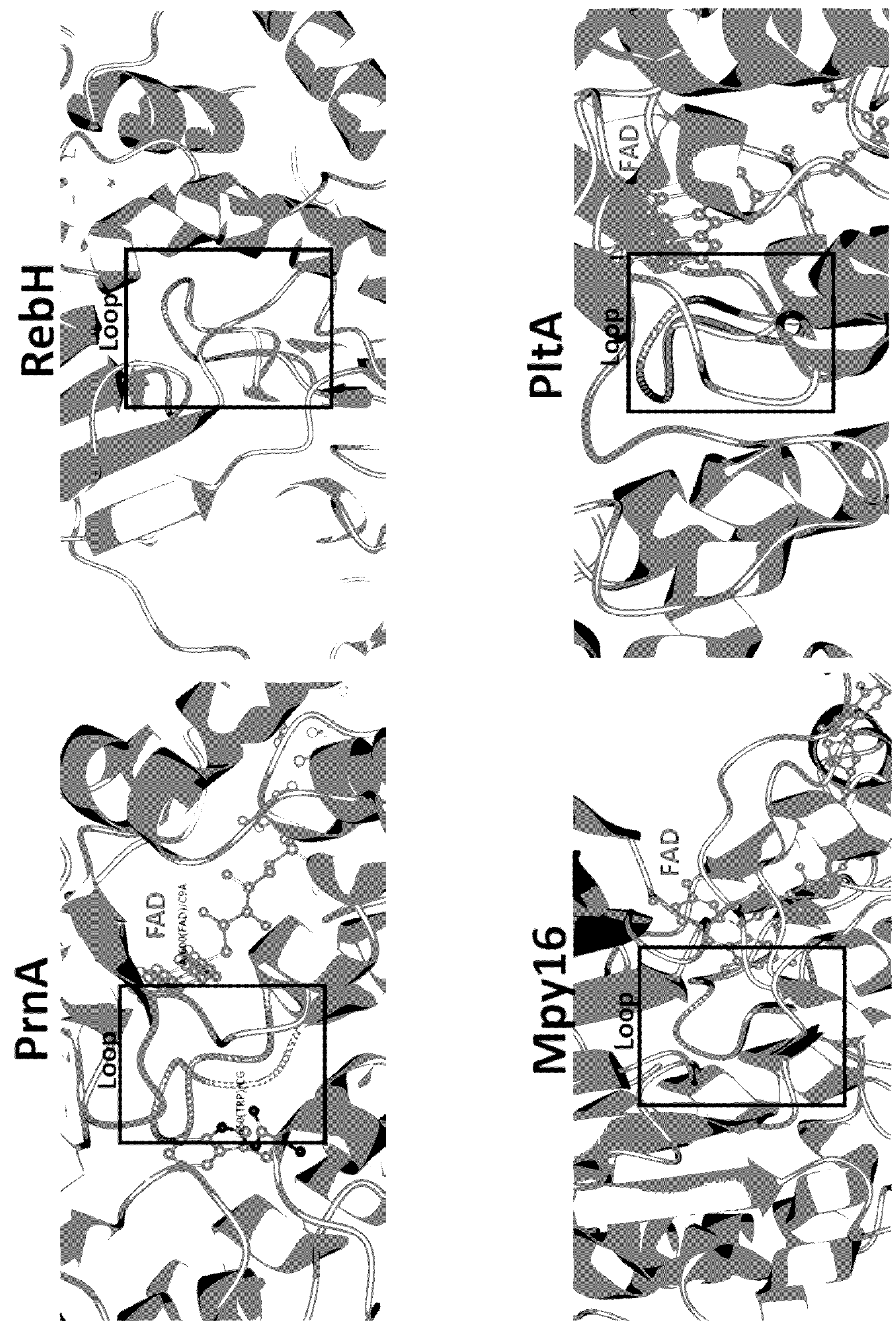

FIG. 4: The looped formed by the FxxPxxSxG motif. The residues of this motif are forming a loop present in all structurally characterised FDHs. The loop is highlighted in red, relative to FAD (if present in structure) and the overall structure. It separates the flavin binding module from the substrate binding pocket where the regioselective halogenation takes place. Image obtained using structural and surface analysis (with CCP4MG molecular graphics software) to structural data of crystalline structure of PrnA, RebH, Mpy16 and PltA deposited in PDB with as the following files: PrnA(2aqj), RebH(4lu6), Mpy16(5buk), PltA(5dbj).

Figure 5:
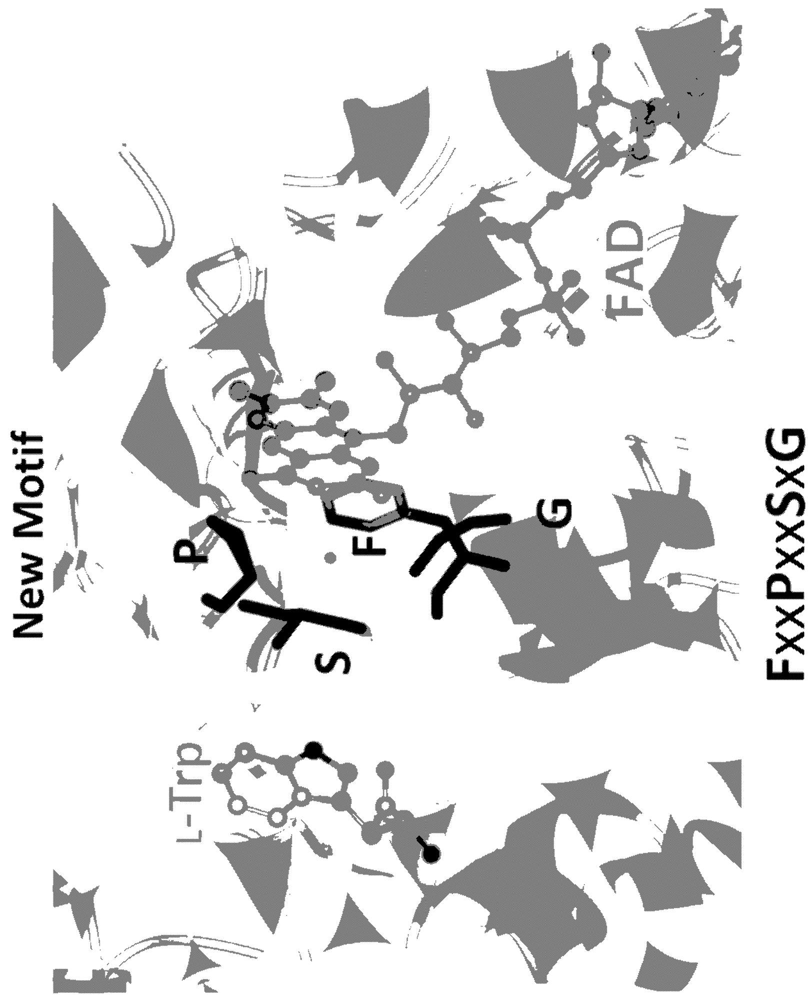
Figure 5:
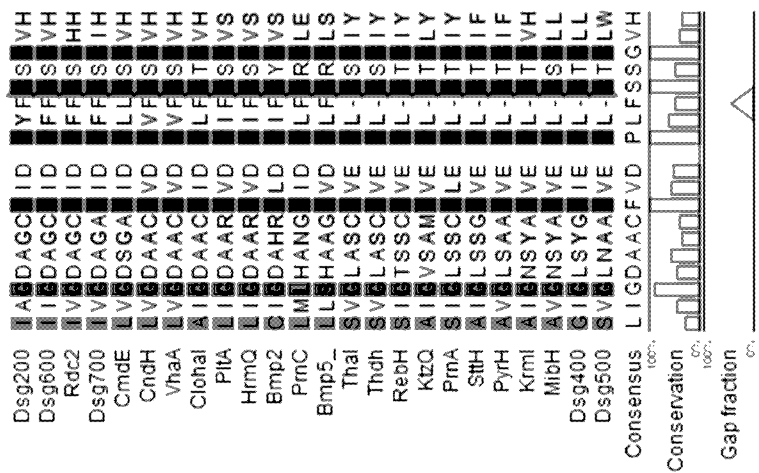

FIG. 5: The FxxPxxSxG motif. Sequence conservation ranging from blue (0% conservation) to red (100% conservation). On the right, each conserved residue of the new motif is mapped (red) onto the crystalline structure of PrnA, in relevance to the tryptophan substrate (green) and the flavin cofactor (orange). Image obtained using structural and surface analysis (with CCP4MG molecular graphics software) to structural data of crystalline structure of PrnA obtained by Naismith et al (*Science,* 2005), deposited on PDB as 2aqj. SEQ ID NOs: 216-237 are shown in the figure.

Figure 6:
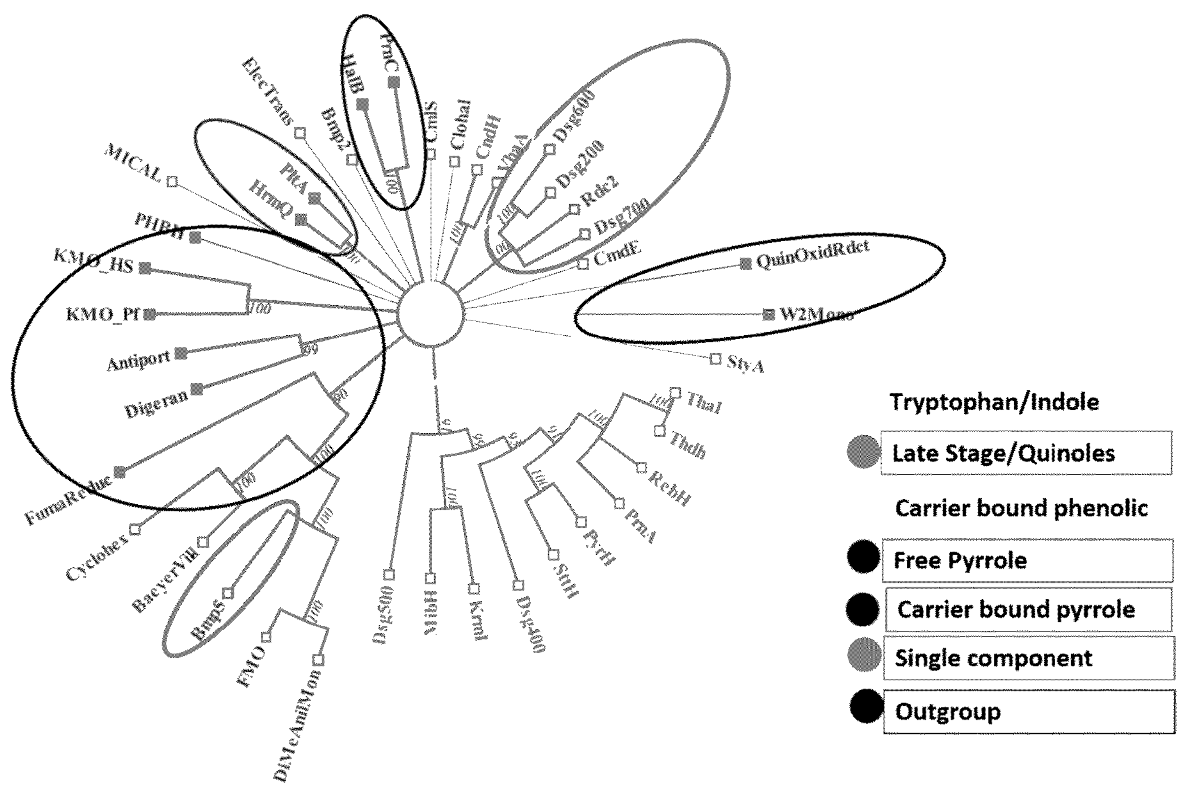

FIG. 6: Colour coded branching clustering of different FDHs based on overall substrate preference. Bootstrapping analysis is shown in branches, to estimate confidence over the branching analysis.

Figure 7A:
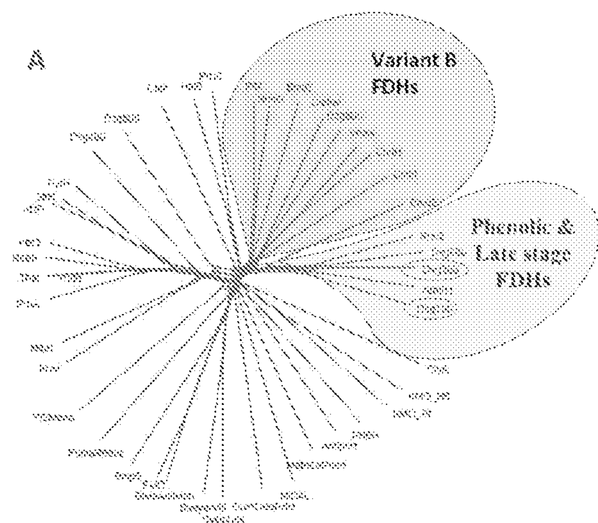
Figure 7B:
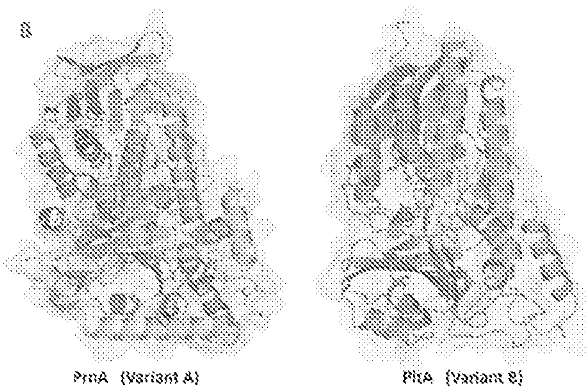
Figure 7C:
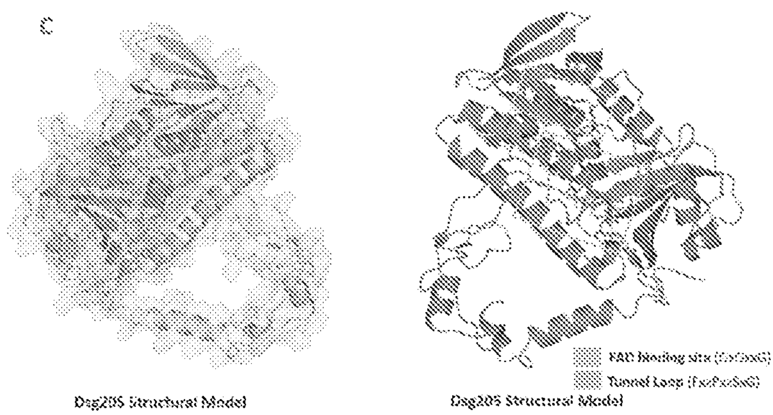

FIG. 7A, FIG. 7B and FIG. 7C: Splitting network and structural model of Dsg205. FIG. 7A) Shows split decomposition network of Dsg205 with variant B FDHs and fungal FDHs. FIG. 7B) Shows crystalline structures of representative variant A and B FDHs for direct comparison with the flexible C-terminus observed in (FIG. 7C) which is our generated model. FIG. 7C) The overall fold of Dsg205 is shown on the left, whereas on the right the cofactor binding pocket (orange) and the conserved motif forming loop separating the tunnel from the active site (green)

Figure 8:
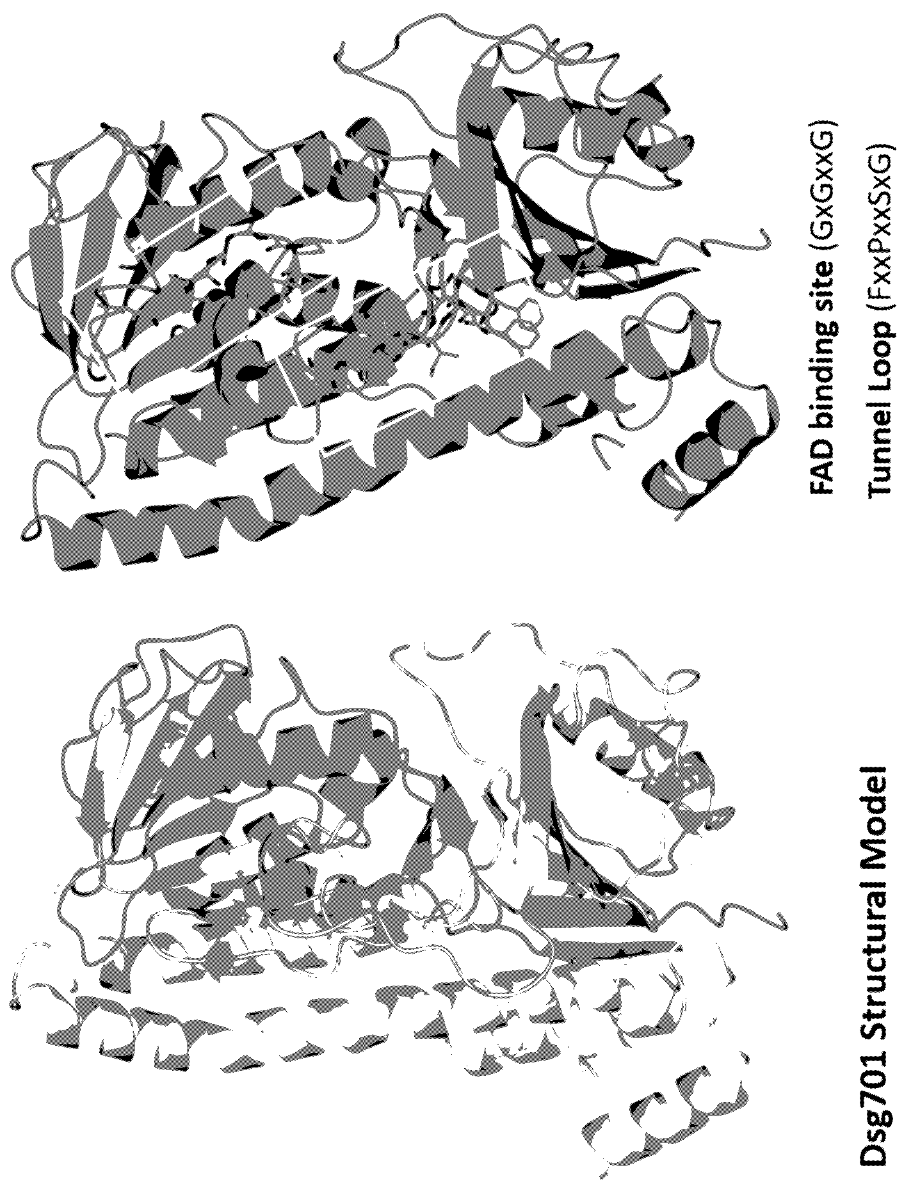

FIG. 8: Homology model of Dsg701.

Figure 9:
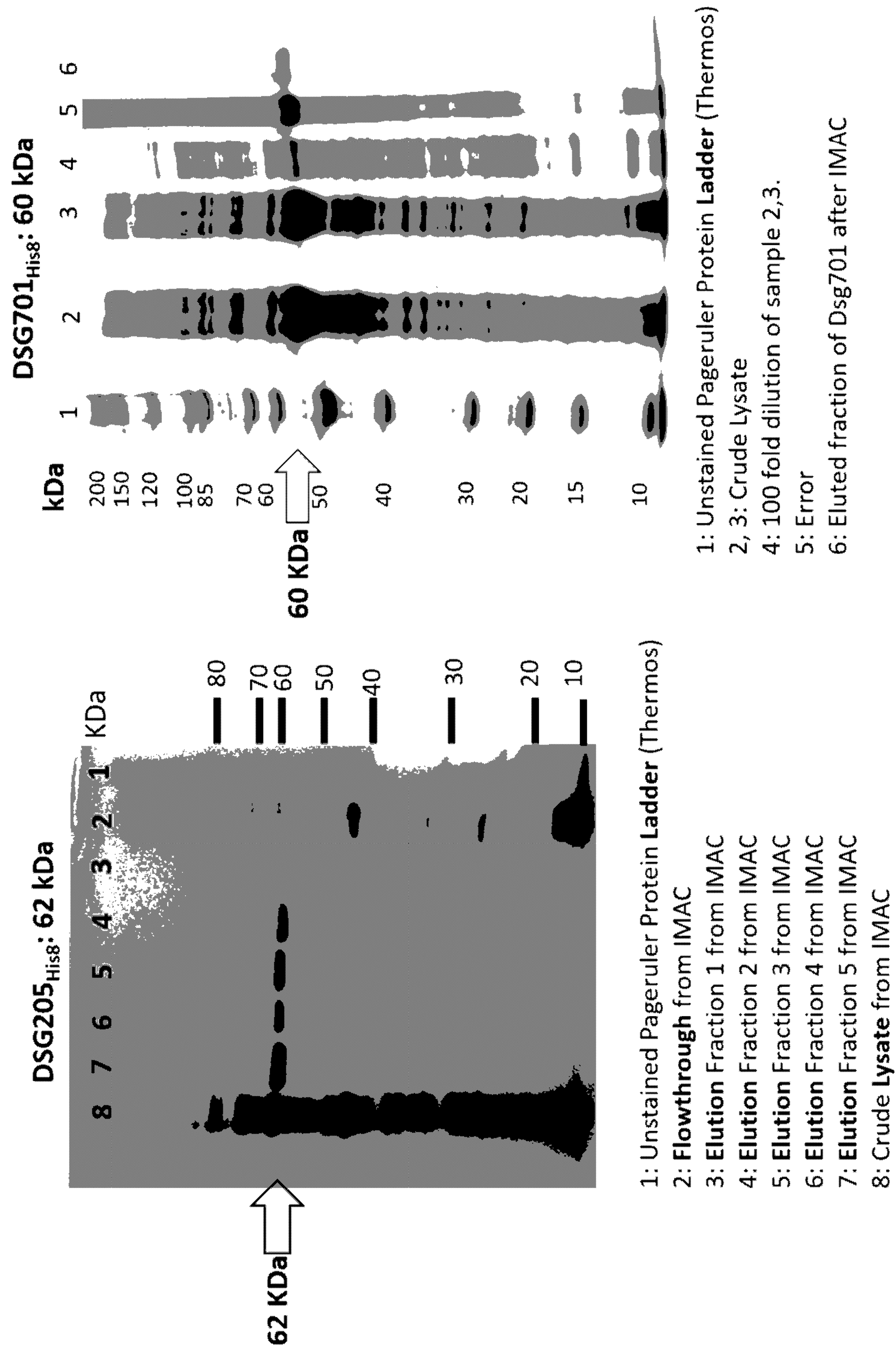

FIG. 9: SDS PAGE electrophoresis of Dsg205 and Dsg701.

Figure 10:
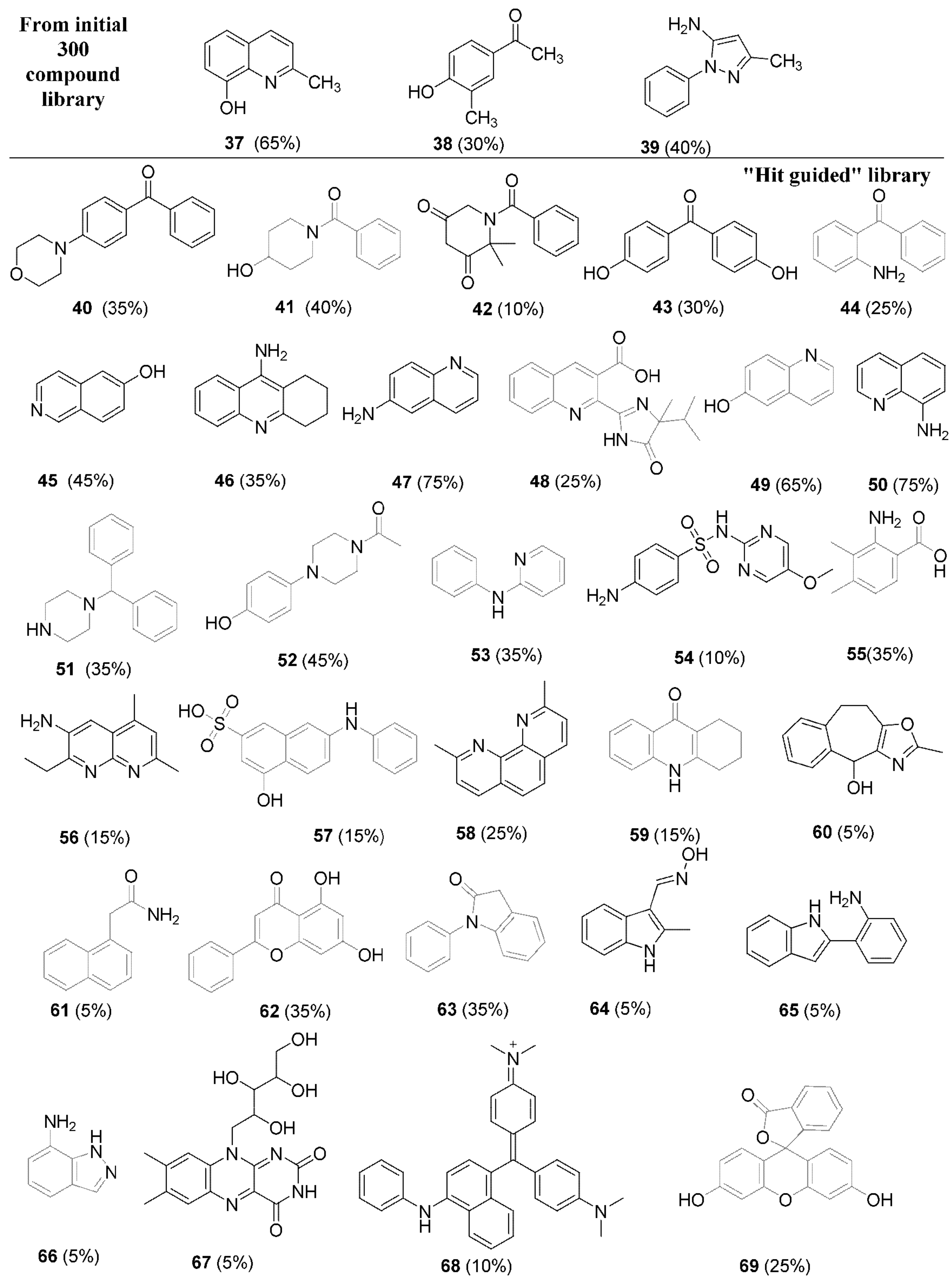

FIG. 10: Substrates accepted by Dsg205. An estimate of conversion based on peak areas of substrate and product. One halogenated product was seen in all cases. Estimates of conversions given above are based on PDA peak areas and do not take into account any change in extinction coefficient. In blue are the substrates that were also accepted by the *Pleurotus ostreatus* mushroom halogenase Dsg701.

Figure 11:
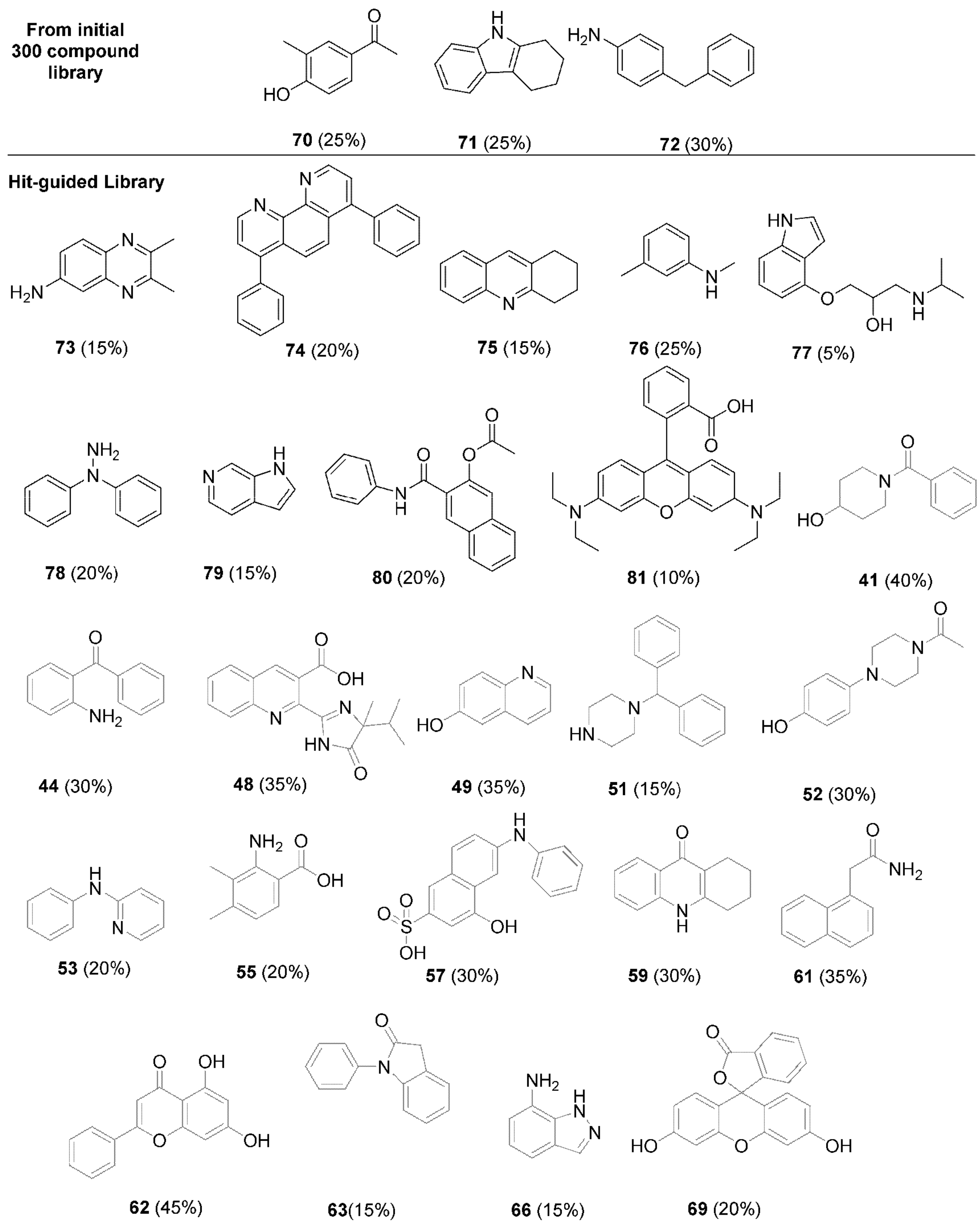

FIG. 11: Substrates accepted by Dsg701 from *Pleurotus ostreatus*. In blue are the substrates that were accepted by both Dsg701 and Dsg205.

Figure 12:
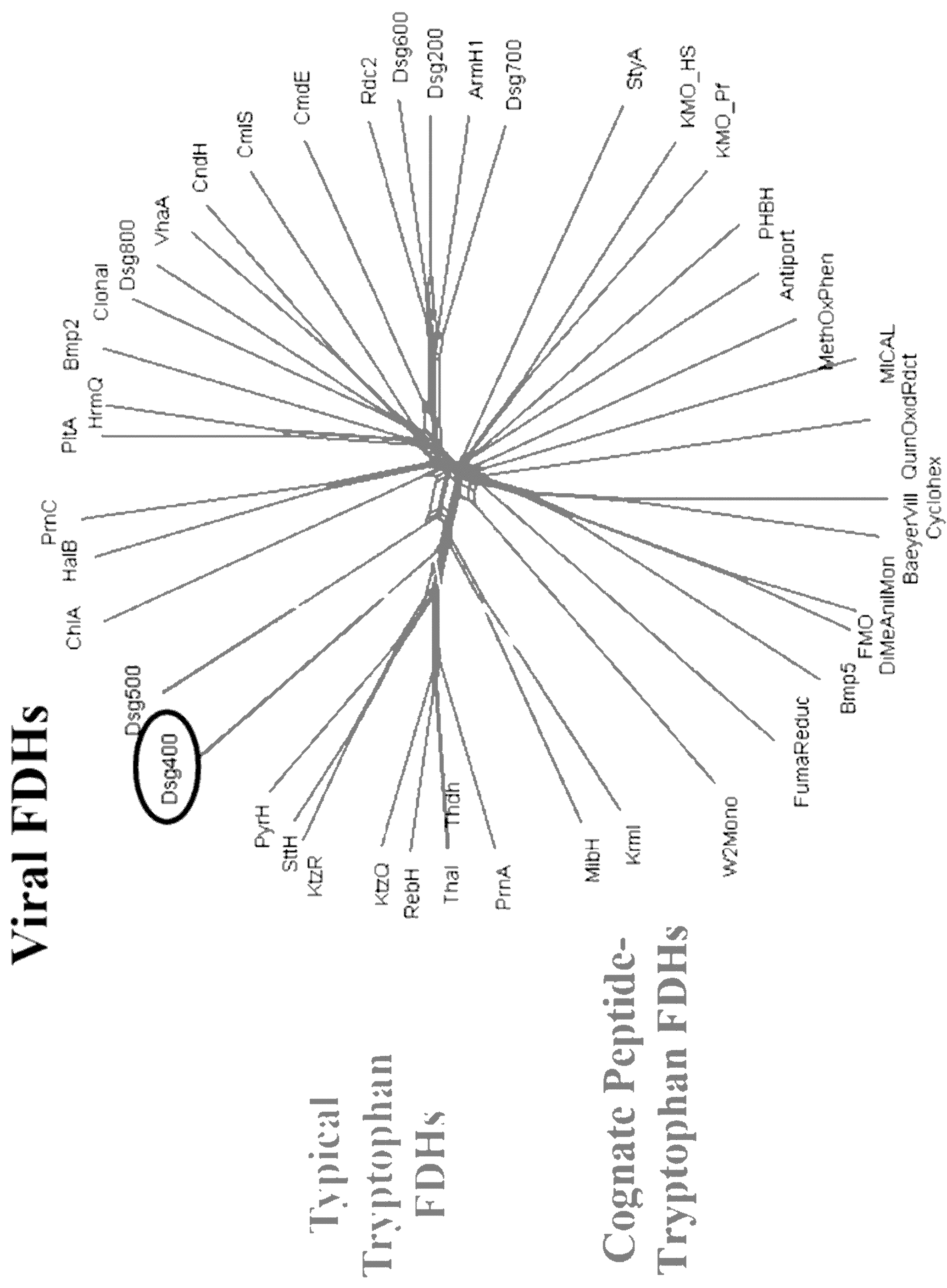

FIG. 12: Splitting network of $MSA_2$. Highlighted is viral halogenases in comparison to known tryptophan halogenases as well as tryptophan halogenases which have been associated with tryptophan containing peptide antibiotics. Branching analysis was performed using Splits Tree software.

Figure 13:
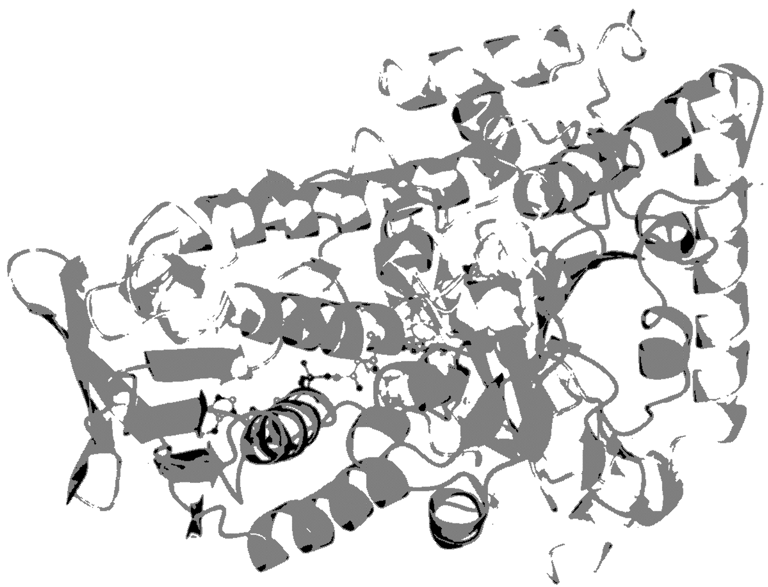

FIG. 13: The figure shows the structural model of Dsg407 generated by Phyre2. In the green box we can see the FxxPxxSxG motif forming the conserved loop separating the FAD binding site (in orange box) from the active site. The figure also shows the crystalline structure of PrnA for comparison.

Figures 14A, 14B:
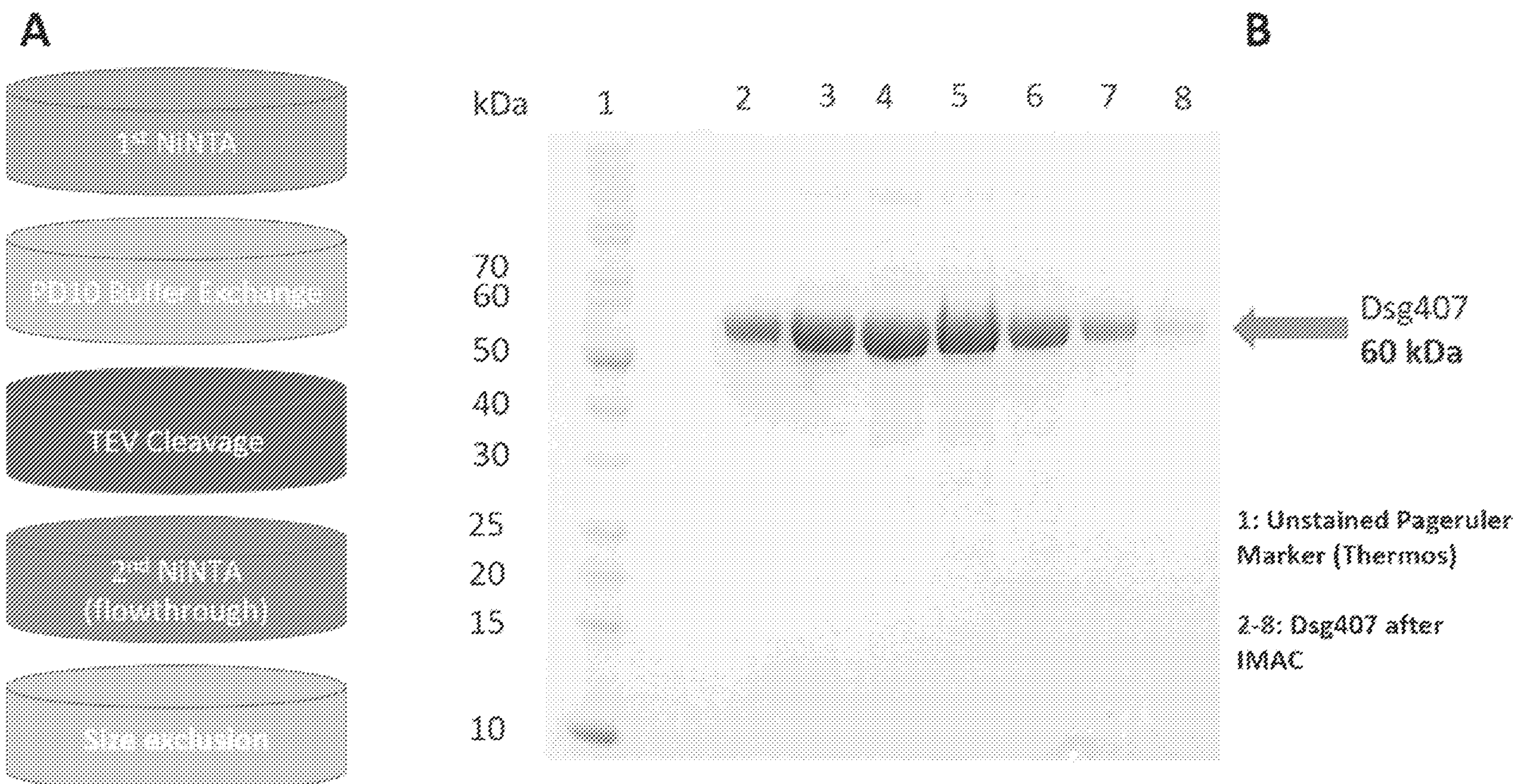

FIG. 14A and FIG. 14B: FIG. 14A) Outline of purification steps in order to obtain B) pure protein without the histidine tag.

Figure 15:
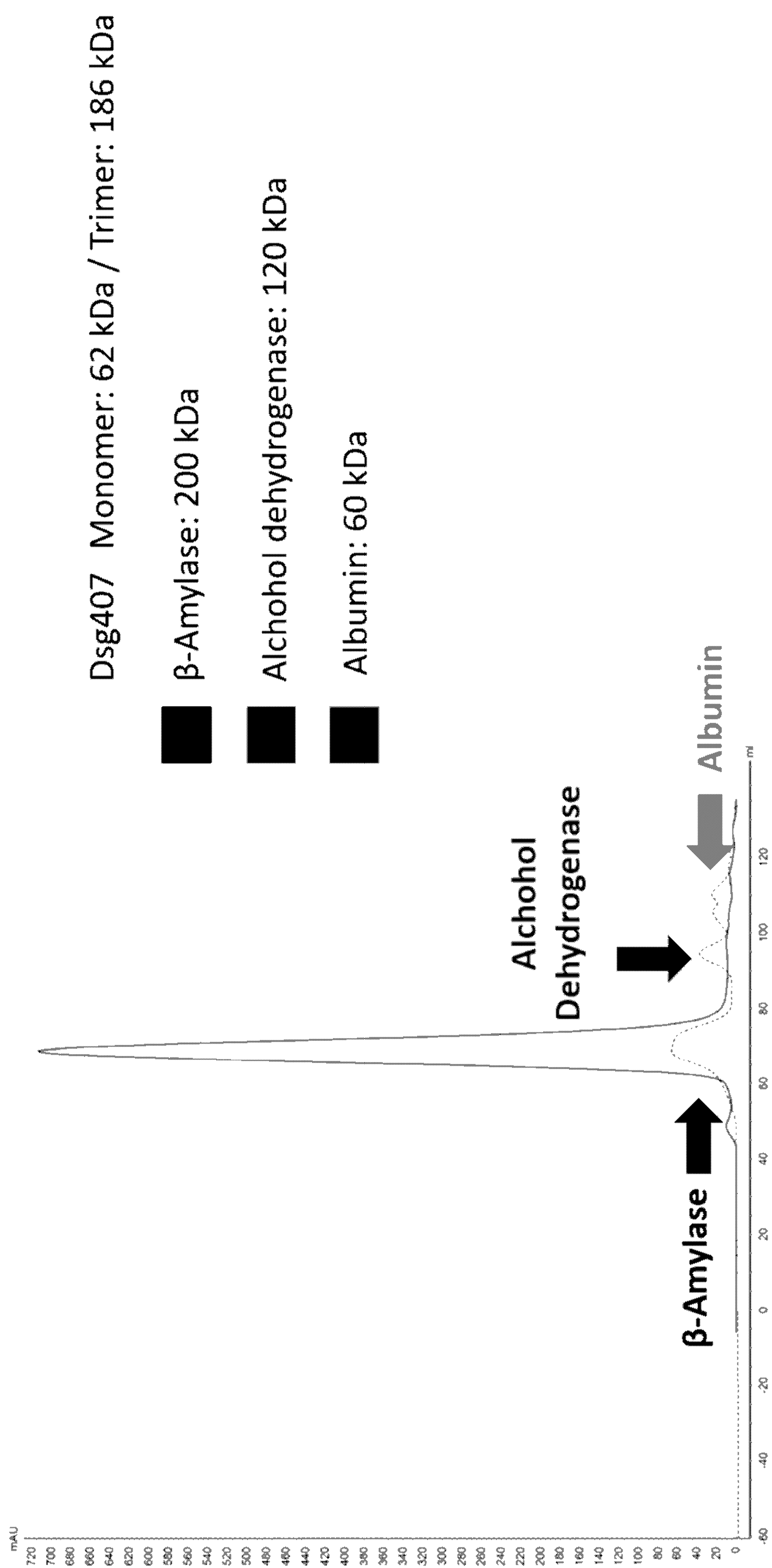

FIG. 15: Determination of oligomeric state of the protein using size exclusion chromatography on a precalibrated column with protein standards. The results are showing that Dsg407 (62 kDa of the monomer) is a trimer (186 kDa), as the homogeneous peak of the Dsg407 sample (in purple) elutes at the same time as β-amylase which is 200 kDa.

Figure 16:
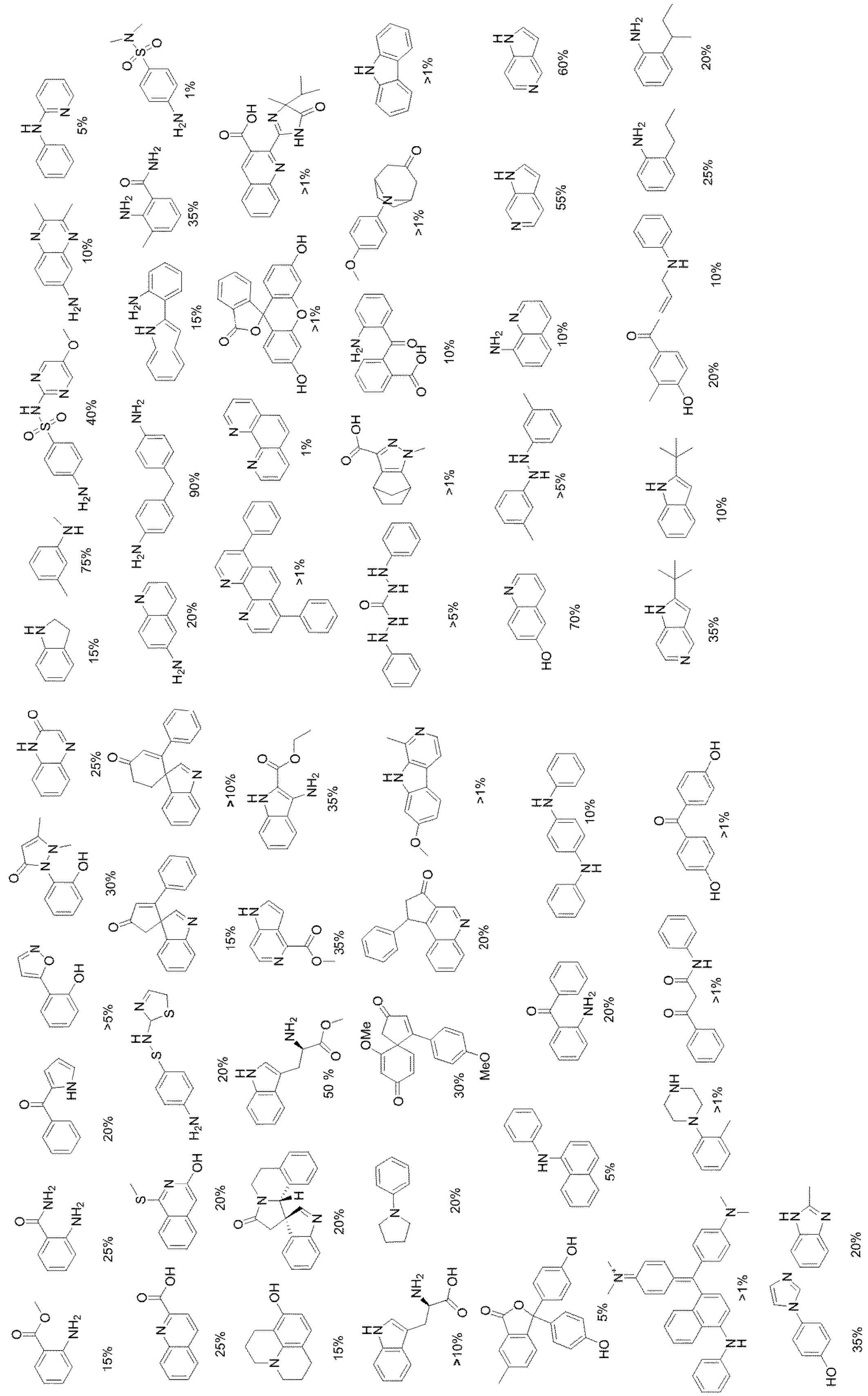

FIG. 16: Substrates accepted by Dsg407. An estimate of conversion based on peak areas of substrate and product. Estimates of conversions given above are based on PDA peak areas and do not take into account any change in extinction coefficient.

Figure 17:
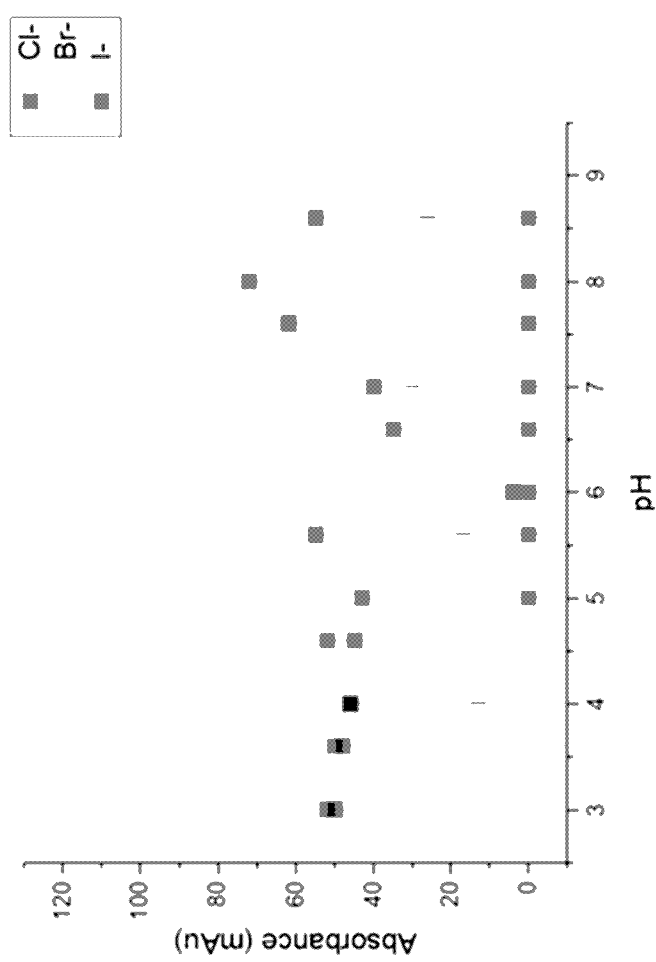

FIG. 17: Summarised pH studies for all halogens (I, Br, Cl) with Dsg407 and 6-azaindole.

FIG. 18A, FIG. 18B, FIG. 18C and FIG. 18D: Structural characterisation of Dsg407 apoenzyme. FIG. 18A) Shows the crystal packing of Dsg407. FIG. 18B) Diffraction pattern of Dsg407 with spots appearing at maximum resolution 2.6 Å. FIG. 18C) Hanging drop of 3D orthombic shaped protein crystals of Dsg407. FIG. 18D) Biologically relevant structure of the trimer of Dsg407.

Figure 19:
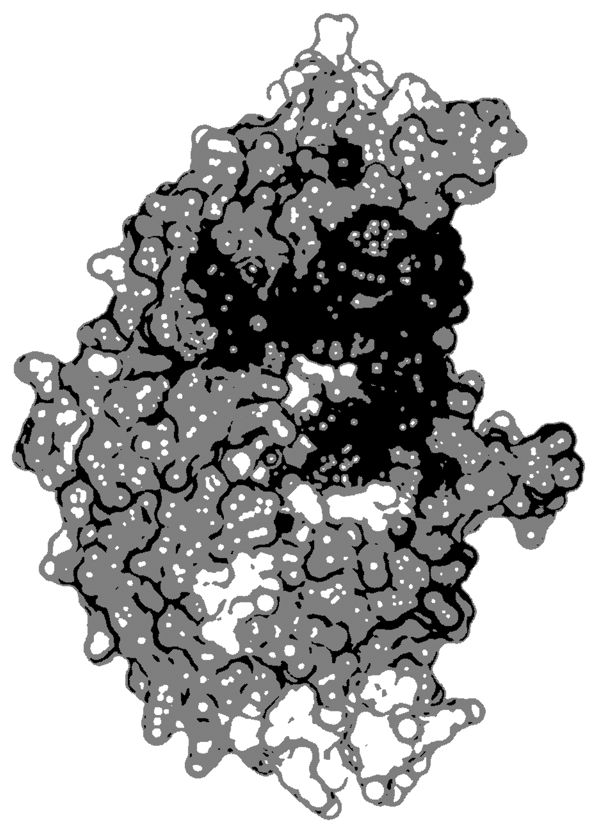

FIG. 19: Monomer of Dsg407 apoenzyme and B-factor model.

Figure 20:
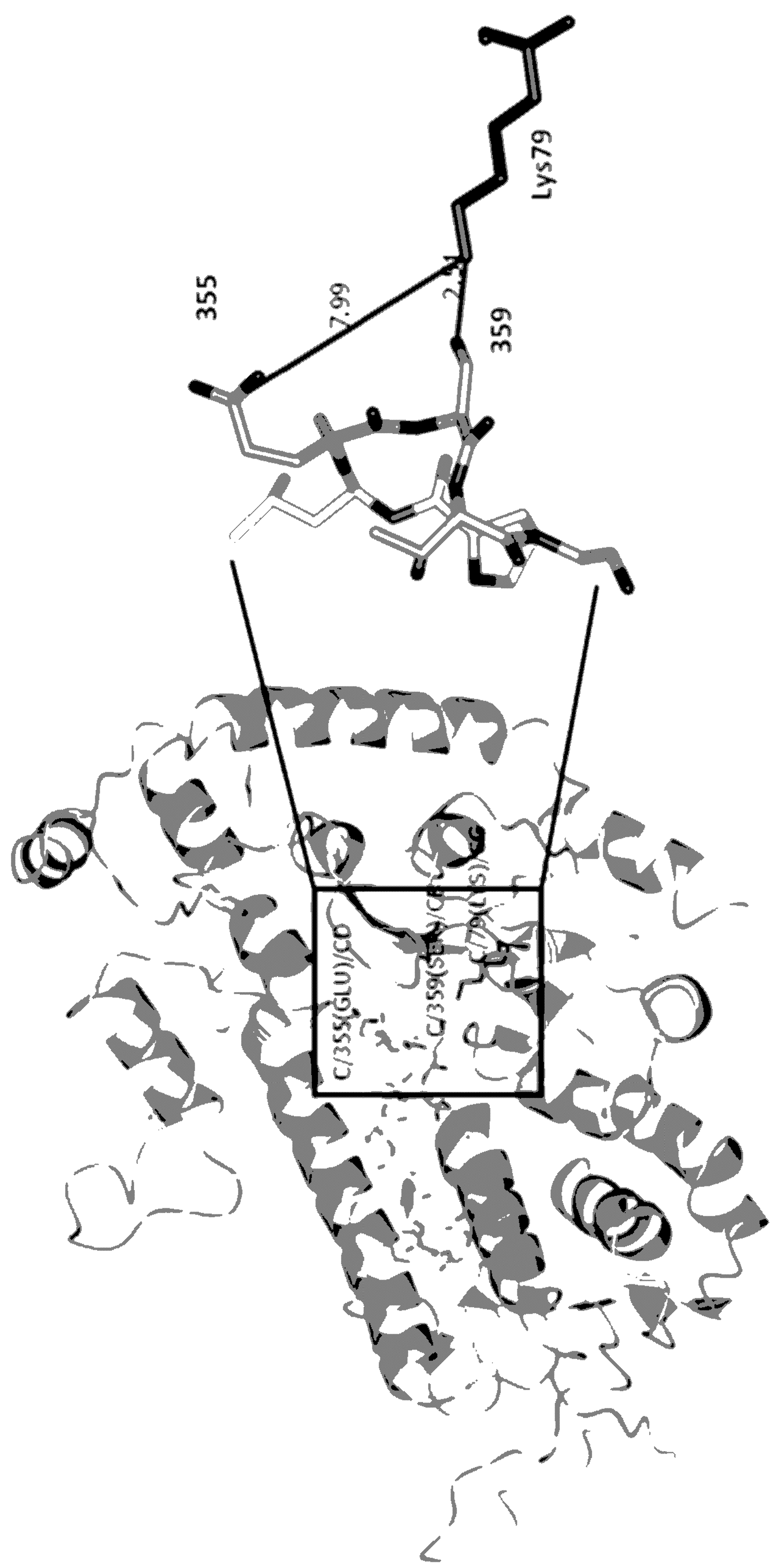

FIG. 20: FxxPxxSxG loop located in Dsg407 apostructure and conserve Lys79 in putative substrate active site.

Figure 21:
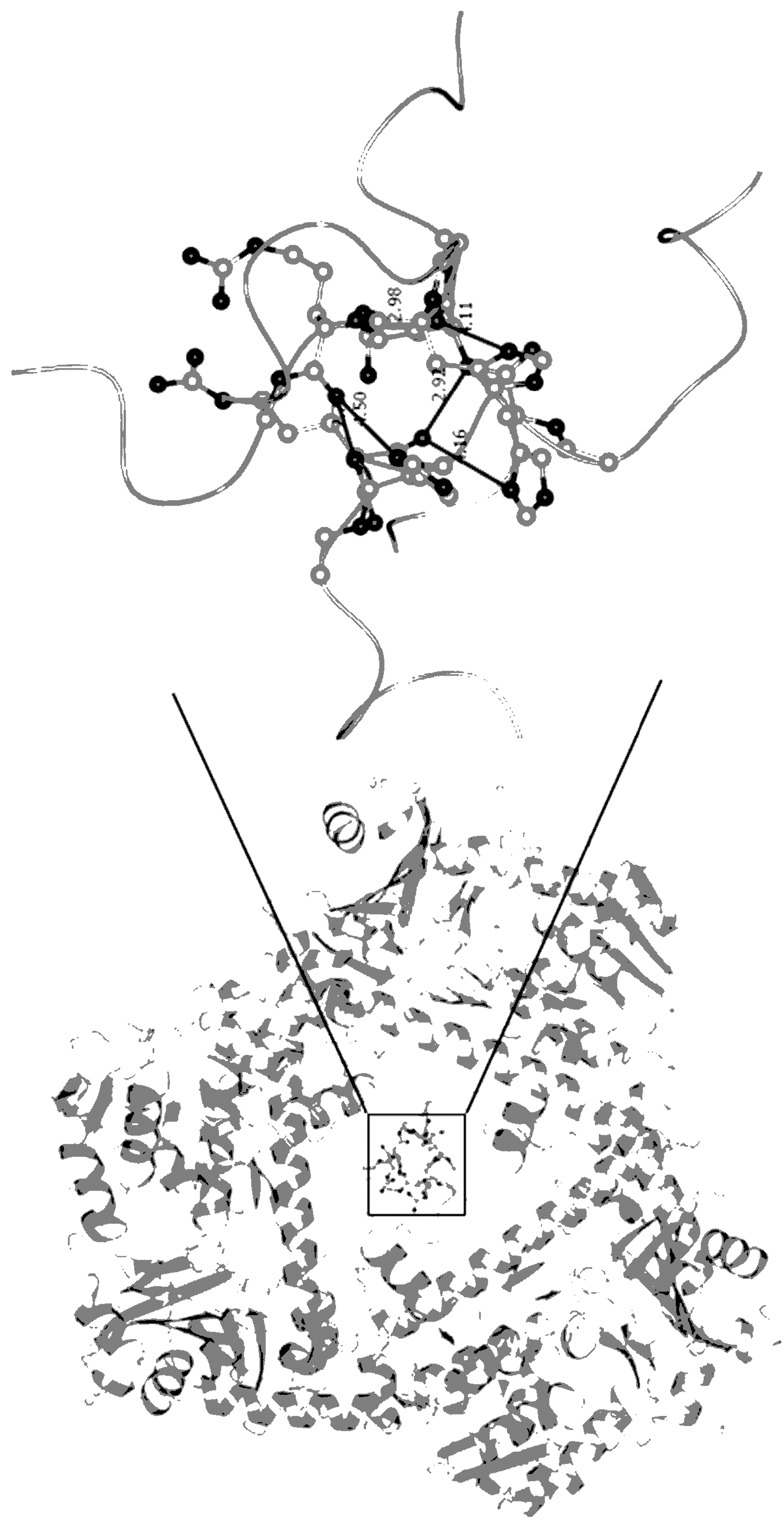

FIG. 21: Extended loop at C-terminus of each monomer of Dsg407.

GLOBAL APPROACH TO DETERMINING DISTINCTLY DIFFERENT FLAVIN DEPENDENT HALOGENASES (FDHS)

The methodology consists of three bioinformatic components. Firstly compilation, alignment and analysis of the complete set of biochemically and structurally characterised FDH sequence data. By carrying out careful analysis on amino acid sequences and structural information of experimentally verified FDHs, series of conserved signature motifs can be revealed.

Second, utilisation of these series of sequence motifs to mine un-curated genomic data. The presence of these motifs, in the expected order provides confidence that the identified hypothetical protein is a FDH. This approach can be utilised to pool series of likely FDHs.

Third by looking at the phylogeny, and focusing on less explored species, distinctly different substrate specificity may be accessed.

Once a candidate is identified utilising this simple approach, it can be synthesised (optionally in gene optimised form), expressed, and its activity assayed. For example, *Escherichia coli* BL21 can be used as an expression platform. A medium throughput LC-MS assay of a 600 member library of small molecules was also developed.

The aim is to develop a method of bioinformatic analysis that is simple and easy and that can be readily adopted by others. Accordingly, the methods described herein have been developed utilising bioinformatics software available online. In this way, users can navigate genomes and pool potentially novel FDHs. A particular advantage of the methods described herein is that non-specialised laboratories can retrieve interesting candidates, within minutes.

Assembling a Definitive Series of Sequence Motifs Found in FDHs that can be Used to Mine, in Silico, for Previously Undiscovered Halogenases.

Structure and Mechanism

FDHs are an intriguing family of enzymes; they are composed of two main domains, the monooxygenase domain and the halogenase domain, connected by a 8-10 Å tunnel. Each of these domains, has its own role for FDH chemistry. FDHs are highly analogous with the two-component flavoprotein monooxygenases with which they share an evolutionary origin. Both families are dependent on a partner flavin reductase enzyme, which reduces FAD to $FADH_2$. Whilst flavin reductases can utilise both FAD and FMN, all FDHs investigated so far require $FADH_2$ and not $FMNH_2$ as their cofactor. PrnA, a tryptophan-7-halogenase, mediating the first step in pyrrolnitrin biosynthesis, was the first FDH to be investigated and structurally characterised; as such is considered the prototypical FDH. Following the first crystal structure of PrnA, 9 more structures of FDHs have been solved so far, all containing the Rossman fold, a motif known to be important for the binding of FAD. Once the cofactor has been reduced by the partner flavin reductase, $FADH_2$ binds to the flavin-binding site of the halogenase, where it reacts with molecular oxygen to form a flavin C4a-hydroperoxide. This subsequently oxidises the halide, bound nearby, (through interactions with the amide NH groups of Gly349, Thr348 and the hydrophobic ring of Pro344 in PrnA), to generate hypoalous acid. This reactive halogen intermediate is not released, instead it is guided through a channel (10 Å in PrnA), leading to the active site, where a conserved lysine residue reacts with the hypoalous acid to form a chloramine (FIG. 1). This chloramine is responsible for the regioselective/regiospecific halogenation of the natural substrates. The involvement of the chloramine in the mechanism of FDHs has been established by both structural (Dong et al, *Science,* 2005) as well as catalytic studies (Yeh E et al., *Biochemistry,* 2007).

Data Assembly, Alignment and Motif Identification

As a starting point, the amino acid sequences of the FDHs with strong experimental data supporting their substrate preference were collected within a local database. This included a comprehensive collection of sequences, as the experimental confidence of the annotation and characterisation of the original data can significantly influence downstream analysis; in other words, the more information we have of the original data being analysed, the more informative the output of the downstream analysis will be. The combination of comprehensive data and appropriate algorithms, can reveal important evolutionary changes such as substitutions, insertions and deletions that have occurred between variants, but can also reveal areas that have been protected by mutations and are conserved even between distant variants.

Due to the difficulties of the in vitro study of FDHs, there are several halogenases where gene knock-outs have confirmed their involvement in the biosynthesis of their associated halometabolites, but their exact substrate preference has not been established in vitro. One of the issues leading to lack of in vitro investigation, could be that many FDHs have been identified in actinomycetes, which are known GC rich organisms. The high GC content renders their genetic information difficult to be overexpressed in different organisms; something necessary for the overproduction of the enzymes from secondary metabolism. Additionally, there are examples of FDHs with solved crystal structures, but unfortunately no in vitro activity has been demonstrated; although there are hints about their associated halometabolites. FDHs have very high substrate specificity and, thus, either their natural substrate or a highly structurally related compound is required for activity. Furthermore, the exact stage of a biosynthetic halogenation step is not always clear and thus it is very often difficult to identify the biosynthetic precursor which is the natural substrate of the FDH. Sometimes a halogenase might act in early stages and the biosynthesis will not continue if the precursor is not halogenated. Other times, it might not affect the biosynthesis if first stage halogenation is omitted. Therefore, FDH gene deletions in the producing strain does not always provide evidence for the natural substrate.

Multiple sequence alignment 1 ($MSA_1$), was performed in order to identify conserved residues across variants of FDHs which revealed three main sequence motifs. Of these motifs, two of them had been previously been identified; these are the GxGxxG and WxWxIP motifs. More excitingly, $MSA_1$ also revealed a third motif which has not been previously identified. This is the FxxPxxSxG motif. This could be either because the alignments so far have all included a disproportionate number of the well-studied tryptophan halogenases; the areas near the C-terminus (where the motif is located) were similar enough to miss the motif. It is also possible that although its presence was clear, it may have just been ignored, as the previously described GxGxxG and WxWxIP were initially considered as the signature motifs of FDHs. Unlike the other motifs, the inventors have found this new motif present in all characterised FDHs. Notably this motif is absent from flavin-dependent enzymes that mediate other reactions such as oxygenations; this is very exciting as the FxxPxxSxG motif can be definitively used for FDH assignment.

The GxGxxG motif is located within the first 20-30 amino acids of the N-terminus. This is part of the Rossmann fold and is present in all validated FDHs. This consensus is also known as the dinucleotide-binding motif (DBM) and is common within FAD and NAD(P)H-dependent enzymes. The importance of the glycine residues is well understood with the first glycine allowing for a tight turn of the main chain, thereby positioning the second glycine such that close contact may be made between the main chain to the pyrophosphate of FAD. The third glycine, allows close packing of the helix with the β-sheet (FIG. 2). This motif has been used extensively for FDH identification. As this motif is shared between flavoproteins, researchers should be cautioned that more evidence than this stand-alone motif is required to definitively predict FDH function.

The conserved tryptophans in the WxWx(IP) motif have been previously described as the signature motif of FDHs (Dong C et al., *Acta cryst,* 2004) (Dong C et al., *Science,* 2005). The two tryptophans, although not directly interacting with flavin, are located at the flavin binding module, and have been proposed by Dong et al to have evolved as a steric block, keeping the substrate distant from the flavin and thereby preventing the enzyme from catalysing a monooxygenase reaction (Dong C et al., *Science,* 2005). However, when W272/Phe and W274/Phe exchanges in PrnA were made individually or together no change in halogenating activity was observed, and even the more extreme W272/Ala mutation made little impact on the enzyme's activity; W274/Ala exchange resulted in enzyme redundancy (Flecks S et al., *Angew Chem Int Ed Engl,* 2008). Tryptophan is instrumental in protein folding and structure, and this result therefore made the inventors to challenge whether the loss of halogenase activity occurred due to potential conformational change, aggregation, misfolding or collapse, and therefore whether the WxWx(IP) motif can really be relied upon to predict halogenase activity.

The simplest way of examining the original hypothesis of Dong et al., (that the two tryptophans of the WxWxIP motif were evolved in FDHs to block monooxygenase activity) was to include in the alignments the ancestors of FDHs; this outgroup needed to be large enough to compete with the FDH numbers of sequences. The inventors gathered experimentally verified sequences of FAD monooxygenases together with all the sequences used in $MSA_1$ and performed $MSA_2$. Not surprisingly, the sequences could align overall. This means that areas that are a result of a deletion or an insertion in addition to various substitutions could be identified. It was shown that many members of the outgroup, including the mammalian monooxygenases have variations of this motif (FIG. 3A and FIG. 3B). For example, kynurerine-3-monooxygenase (KMO) from *Pseudomonas fluorescence* has a WxHx motif, whereas KMO from *Homo sapiens* has a WxRx motif. Similarly, a Baeyer-Villiger oxygenase has a deletion over the first W and contains tyrosine instead of the second tryptophan, thus leading to the motif YxVP.

PHBH contains a phenylalanine instead of the first tryptophan and others like geranylgeranyl reductases have a YxWxxP motif.

A third motif, FxxPxxSxG, which to our knowledge, has been overlooked in previous multiple alignments of halogenases caught our attention. We sought to investigate how this third and previously ignored sequence motif maps onto the available structures of FDHs. Intriguingly we saw that these residues are present in a loop that separates the active site from the isoalloxazine ring of the flavin cofactor binding pocket, in all solved crystal structures of FDHs (FIG. 4). In the structures of PrnA and PyrH the cofactor has a direct interaction with residues of this loop. Similarly, in PrnA the amine of the indole ring is also directly interacting with the loop. This loop may be seen to be always present in FDHs whether they act on a free or enzyme tethered substrate.

In a given fold, structural variability is a result of substitutions, insertions, and deletions of residues between members of the family. Such changes frequently correspond to loop regions that connect elements of secondary structure in the protein fold, and therefore, loops often determine the functional specificity of a given protein framework. It may be that this loop plays an important role in substrate specificity and active site configuration, which is the reason why nature has kept it protected from spontaneous mutations, as conservation correlates with functionality.

Unlike the other motifs, the newly disclosed motif has been found to be present in all characterised FDHs (FIG. 5).

Notably the new motif is absent from flavin-dependent enzymes that mediate other reactions such as oxygenations.

The identification of this motif enabled for the first time the definitive identification of FDHs in silico. Together with mechanistic and structural knowledge, the newly identified FxxPxxSxG motif permits the prediction of FDH function, even at low sequence similarity.

Mining, in Silico, for Previously Undiscovered Halogenases, Using a Phylogenetically Guided Approach.

We further used MSA2 for the construction of a phylogenetic tree (FIG. 6).

Bootstrap analysis was used for both the phylogenetic tree as well as split network. Within this phylogenetic tree we saw that FDHs clustered according to substrate preference.

Tryptophan FDHs appear to cluster together, separate to the pyrrole FDHs.

Free pyrrole FDHs form a distinct cluster in comparison to the ACP bound pyrrole FDHs. (The addition of the outgroup was very important for the construction of a meaningful network, that could be used to extract information about the substrate preference.) This phylogenetic tree provides an excellent starting point for the discovery of halogenases with very different substrate preference to those which have previously been investigated. Using this tree we chose to investigate a series of phylogenetically distinctive halogenases. The encoding genes were codon optimised, synthesised and their gene products analysed. All of the genes resulted in soluble protein and halogenase activity could be determined.

We outline below our approach to halogenase discovery and biocatalytic investigation, and describe two examples.

Example 1: Identification of Dsg205 from *Trichoderma virens*, a Plant Beneficial Fungus

*Trichoderma virens* is a haploid filamentous fungus, known for its beneficial role in plant growth. Its 30 Mb genome is predicted to contain about 50 secondary metabolite gene clusters, half of which can also be found in other Ascomycota species such as *Trichoderma* atroviride and *Trichoderma reesei.*

Previous genomic analysis has revealed non synthetic genomic islands containing several monooxygenases and oxidoreductases and many other potential gene products, the annotation of which has so far been unsuccessful due to the low sequence similarity to known proteins.

Although it has become apparent that this organism might contain an as yet undiscovered reservoir of secondary metabolites, its ability to produce halogenated metabolites is known, making its genome an excellent model for FDH hunting, balancing both challenge and potential for our novel genomics led approach to successfully identify halogenases.

The halogenase amino acid sequences (fasta format) which were used to construct Multiple Sequence Alignment 1 ($MSA_1$), was added as a query sequence in blastp suit. The database used as a search set was the non-redundant protein sequences (nr). The search parameters were changed to only search against *Trichoderma virens* Gv29-8 (taxid: 413071). PHI-blast was selected as the algorithm and the FxxPxxSxG motif was included as the selected pattern. This yielded three hits all of which had been annotated as "hypothetical proteins".

These were "hypothetical protein TRIVIDRAFT_60172" (this is Dsg205),

```
"hypothetical protein TRIVIDRAFT_192594" amino
acid sequence:
                                   (SEQ ID NO: 150)
MANIPEQCTVLVIGGGPAGSYAASALAREGIEVVLLEAEKFPRYHIGES

MLPSMRHFLKFIDAYEKWDAHGFNIKKGGAFRLNWSRPETYTDFIAAGG

PGGYAWNVVRSEADELLFKHAAECGVQTFDETKVASIEFAPATSDVQSL

GRPVSATWTRKDGSSGTVSFDYVVDASGRAGLISTKYLKNRSYNQGLKN

VASWGYWKNGGVHGVGTHKEGAPYFEALKDGSGWVWFIPLHNGHHSVGV

VQNQEMAAKKKREMTEPSSKGFYIESLDLVPGIKELLANAELVSEIKSA

SDWSYSASKYAFPGVRIAGDAGSFIDPFFSSGVHLALSGGLSAATTIAA

AIRGDCGEKAASSWHDKKTAESYTRFLLVVSSALKQIRSQDEPVINDFD

EATFERAFDLFRPIIQGQADADAKGKLTQAEISKTVEFCFKAFAHVSFE

EKEALVKKLKELGLDGDAYDESNRKALDELEKKLTPEEQSILKTLKGRR

MVRPEDSLNIDNFTLDSIDGLAPRLERGKLGLATAKKAEVKFTRHDPLS

FLNGESKAVKKALQNGHAELNERSEVHSTNVTNGDKPLNGHTKVEDQSV

ASLVAELVASERSLPQASLDESSRHRLISSLQESAEELETPYDSMLRFL

NASRQIALIKIGGDLGIFKCLAESKTPLSSKELAKPNMADPTLVGRIMR

YLVANRLAAETAPDQYVARKMTYALADPQIEGPMRFFHAVSSPSFQALP

DFLKETGYQNQPQTSALQKGLNTDLGLFAWLKQHPDLLKDFQNLMGIPK

EGNCLDVISFESAVIGGHEGPVFVDIGGNTGHQAKQLLAKYPELANRVV

VQDREETIKSASDVKGFQLMAHDFFSPQPVQGAKYYYLRAILHNWDDDK

ASQILSNIVPSMSTDSLMLIDELVIADQGSHVWPAGLDLQMYTLFGSSE

RTASQWDSILDRAGLRPVAVKKYAPVMGSSVIFAAPKFRCYTTL.
and
```

-continued

"hypothetical protein TRIVIDRAFT_53554" amino acid sequence:

(SEQ ID NO: 151)

```
MAATAPVPKHTFAERAAANNLSDSQILNSNNVAGSSLPKESDVVIAGGG

IHGLIYAIHSAKHKPGNLKILLVEKNRKPGYKIGESTLPVFSMWCKMYG

LTAEYLLRIFGLKDGLCFYFLDRENQGKFKDFVINGTAGTLLSGFQIER

PTSELLFTLLAQRSGVNVYHGTEVNFDGTTVDGGLNKCNIGIAKGKSND

TPETSIQSSILVDATGRFRRVASKNAPIHRFEGWNYDAFWGYFTNPKDT

SKMPFPHYESCNTNHICFPEGWIWVIRLLSWEGSPTANLMDMMTYLLDC

AESGVPADQIPSTDELAKMFGLNYRWITSLGFAVRNDVEYPEDMSAYGT

REAERRFNYFVEKYPLIKEFMSNFELIEDHYGPGTTWYIRKSLTYQSPV

VSGPGWISIGDACGFTNPLWSPGINVGLSTSTYAAELTHKAFDAAKNAN

PEAAELSIRETMAPYDAYAKRLIPALNQMNCFNYVCFRDPRLGAQISAA

WQNIASALQGWGRIQGNYTLTPETFVDYATNWCYGAINPAYDIVARKAI

ELLAPIPLKDAVPDHIVQEVIEFADSIKKSTLESGCINLRWGGLFRRFD

NRLNYLEEKETKDTFARPCSNCSSWFVLRPDWKKCYSCGTERTDEESTI

LWNPVLV.
```

As a comparison, the searches were repeated with the GxGxxG motif, which yielded 20-30 hits, as well as with the WxWxIP motif which yielded only 2 hits. Using the WxWxIP motif failed to reveal the "hypothetical protein TRIVIDRAFT_53554" as the proline residue of WxWxIP had been substituted with arginine in this variant. However, using the GxGxxG motif retrieved twenty hits comprising all flavin-dependent enzymes present in the genome, including the three halogenases that we identified with the FxxPxxSxG motif. These results together demonstrate that FxxPxxSxG is the motif to be used for fast and definitive FDH identification. The three FDH candidates identified using this method showed no significant similarity to tryptophan halogenases. More specifically when the tryptophan 7 halogenase (PrnA) was aligned against TRIVIDRAFT_60172 the two sequences could only align 50% of their sequences, with a sequence identity of 21% (sequence similarity 35%) with the major differences located near the C-terminus of the sequences. When this terminal sequence was aligned against the UniProtKB/Swiss-Prot database, it only showed moderate similarity in the C-terminus area with the Rdc2 fungal halogenase (47% sequence identity, 55% sequence similarity) and even lower similarity to pyrrole halogenase PrnC (22% sequence identity) which aligned against 66% of the sequence. All three identified FDH sequences of *Trichoderma virens* showed a comparable low similarity to known FDHs.

Out of these 3 halogenases identified in the *Trichoderma* genome, we chose TRIVIDRAFT_60172 (later renamed as Dsg205) to test in vitro.

The possibility of Dsg205 acting on carrier bound substrates was next assessed. We have been able to predict such specificity by employing a phylogenetic-like branching analysis. As the question asked was how similar Dsg205 was to known FDHs and in parallel how different it was from variant B halogenases which require the substrate to be carrier bound, we employed split decomposition to generate a splitting network, a variation of branching analysis (FIG. 7A). Each split represents evolutionary distance. The model showed that Dsg205 was definitely not clustering with variant B halogenases as shown by the splitting of the two subgroups. Dsg205 clusters together with the fungal halogenases which have been shown to be more promiscuous accepting substrates of a range of series, in comparison to tryptophan halogenases.

Structural models of Dsg205 were next generated using the Phyre2 protein fold recognition server (FIG. 7B and FIG. 7C). These models have a 100% confidence rating over 76% coverage of the original sequence. Disordered areas could be modelled at >90% confidence using multiple templates of 120 proteins with domain similarity. We could identify the active site through the presence of the conserved FxxPxxSxG loop which separates the FAD binding site from the substrate binding pocket.

A previous proposal has correlated variant A (acting on free substrates) and B (requiring carrier bound substrates) halogenases with the degree of structural order on the C-terminus (ordered in variant A, disordered in variant B). However, this correlation is not definitive as a recently a biochemically characterised variant B member, PltA, was structurally elucidated showed a mostly ordered C-terminal region (FIG. 7B and FIG. 7C). It seems that this region serves to obstruct the active site from entrance of free pyrrole-2-carboxylate. A conformational change which most likely involves movement of C-terminal region to open access of the halogenation site to the carrier protein-tethered pyrrolyl moiety is necessary. The model we have generated does not show this sealing of the active site (FIG. 7B and FIG. 7C). Instead the dsg205 structural model suggests a rather expansive active site able to accommodate a variety of small and larger substrates, this is in agreement with our branching analysis.

Example 2: Dsg701 from *Pleurotus ostreatus*, a Common Edible Mushroom

The same methodology for identification of novel FDHs was used against the genome of *Pleurotus Ostreatus* PC15 (taxid: 1137138), otherwise known as the oyster mushroom. *Pleurotus ostreatus* is an active lignin degrader in forests and is also the third in the worldwide market of industrially produced mushrooms. Until now, there has been only one halogenase characterised from an edible mushroom and that is ArmH1 (and its homologues from the same producing organism). The FxxPxxSxG motif retrieved 4 potential FDHs in the *P. ostreatus* genome. These were hypothetical protein PLEOSDRAFT_1093300 (later renamed Dsg701), hypothetical protein PLEOSDRAFT_1079235 (amino acid sequence (SEQ ID NO: 152):

```
MASIAVPSASTILVIGGGPGGSYSAAVLAREGLDVVLLEADKFPRYHVG

ESQLASLRHFLRFIDLEKEFEEFGFQRKDGAGFKLNRHKREGYTDFVSQ

DPNNFSWNTVRSQADELMLRHASKCGAKVFEETKVTELEFEGSEQSGRP

VAALWKQKSGATGRITFSYLVDASGRNGIMSTRYLKNRQFNSLLKNVAC

WGYWEGTGKYLPGTSRENSPLFEALADESGWAWFIPLHDGTTSVGIVMN

QDISNEKKAKAKESGEDTSLVAHYLSELKRAPNVLALIGDGVHIKKSDA

PLISAASDYSYSATSYAGPHYRIVGDAGAFIDPYFSSGVHLAISGGLSA

AATICAEMKGGCTSTEAIAWHSAKVDTSYTRFMLVVLSAYHQIKSQEAP
```

-continued

VLSNKDEDNFDRAFDFFRPSKYRTDWTFIQGNTDVGRKLQGDDLRRTVE

FCAKHAYEPSLPEERKELVEKFGDPLRVLSAESAEDSEQVATEKRILKG

VAIRKLMRTEDIVHIDNFVADNLLGYKLRLIRGSLGLEKVL, hypothetical protein PLEOSDRAFT_1108187 (amino acid sequence (SEQ ID NO: 153):

MSLPRIPQRTTVLVIGGGPAGSYASTLLAREGLDVVLLEALKHPREHVG

ESMLPSMRQYLRFIDLENEYDIRGFLHKPGAFFKFIHGAPACYADFDIL

GRDKNTWHVFRAEADELMLRHAAQQGVKVFEEVRVDSTEFAGSDPTTSR

PIAANWKSKLGETGALSFDWLIDASGRQGLMATKYLKNRIYREGLRNVA

AYGYWEHAAAPVEEGNPRQNATWIECLTDKRGWAWHIPLHNGKTSIGVV

MHQETSNQKKAVGPKGLEAHYLDQVKLAPGVLERLGHGASYITGSVRST

ADFSYHAKSYSGDHYRIIGDAAAFVDPLFSSGVHIGMTGALSAACTILG

SMKEQITEVGACAWHDAKIGISQIRFLLVVLSAYRQMQHQGNYTVLGDF

NPQDFGRAFELFRPVYQGQHDVENKLTNEELERMIDFTRNFFLPISQDQ

HAAVSERLGHFMPINGPVMGPDDLAKVLDDDDSDAKAVLQKINARKVLS

TEMGSSGLNSESVNGYTLILEKGRLGMKKEIGVA and hypothetical protein PLEOSDRAFT_1103280 (amino acid sequence (SEQ ID NO: 154):

MSLPRIPQRTTVLVIGGGPAGSYASTLLAREGLDVVLLEALKHPREHVG

ESMLPSMRQYLRFIDLENEYDIRGFIHKPGAFFKFIHGAPECYSDFDLL

GQDKRTWHVFRAEADELMLRHAAQQGVRVFEEVRVDSIEFAGSDSMSSR

PITANWKSKLGETGAISFDWLIDASGRQGLMATKYLKNRIYREGLRNVA

AYGYWENAPVEEDGSHQNATWIECLTDKRGWAWFIPLHNGKTSVGIVMH

QETSNQKKADGPKGLEAHYLDQVKLAPGVLKRLGNDATYITGSVRSTAD

FSYHAKSYSGDHYRIIGDAAAFVDPLFSSGVHIGMTGALSAACTILGSM

KEQVTEVEACAWHDAKIGVSQTRFLLVVLSAYRQMQHQGNYTALGDFNP

QDFGRAFELFRPVYQGQHDVENQLTNEELERMIDFTRNFFLPVSQDQYA

DVGERFGQFTEINGPVMGPDDLAKVLDDDDSDAKAVLQRINALKVLSNE

MGSSGLNSEAVNGYTLVVEKGRLGMKKVINA

The closest orthologue to PLEOSDRAFT_1093300 is a hypothetical protein from *Agaricus* mushroom, which are both edible and poisonous species. When compared its sequence against Dsg205 from *Trichoderma virens* it was shown that the two sequences have 45% sequence identity and 60% sequence similarity.

When I analysed the gene clusters of *Pleurotus ostreatus* PC15 I identified 22 clusters which did not share sequence similarity to any known BGCs. The only FDH which was in a BGC was hypothetical protein PLEOSDRAFT_1079235. The other three are probably scattered around the genome of *P. ostreatus*.

The first FDH example identified from uncharacterised genomic deposits was dsg205 and we were able to carefully annotate the candidate and the neighbouring genes, to obtain as much information possible for the activity of Dsg205. However, one of our aims is to be able to show activity in sequences that there is no information about their function, other than our annotation. We therefore selected the hypothetical protein PLEOSDRAFT_1093300 as our next candidate for production and assessment of halogenase activity, as the only information available about PLEOSDRAFT_1093300 is that it contains an open reading frame and might be a protein and therefore the level of challenge is what we need to show activity. We named this candidate Dsg701.

Branching analysis (see FIG. 7A) revealed that Dsg701 did not require a carrier bound substrate. We also generated a homology model (FIG. 8) with which we can see a more ordered C-terminus in comparison to Dsg205, with an equally open access substrate binding pocket indicating likely broad substrate specificity. Dsg701 was selected for codon optimization synthesis and heterologous expression in *E. coli* BL21.

Protein Production and Purification

We designed a codon optimised gene for the heterologous expression of Dsg205 and Dsg701 in *Escherichia coli* BL21. We cloned these genes individually into the pUC19 vector enabling the introduction of a TEV cleavable N terminal octahistidine tag to ease purification of each protein. The resulting constructs were named pDSG205 and pDSG701. Conditions that would enable good levels of protein production were screened More specifically small scale cultures were used to determine conditions for each construct that resulted in the production of good levels of soluble protein. A single colony, from a fresh transformation in BL21 (DE3) chemically competent cells was used to inoculate 10 ml LB medium containing appropriate antibiotics. In most cases the expression vector used was pSG181, which carries a kanamycin antibiotic cassette. The culture was incubated over night with shaking at 37° C. The starter culture was diluted 100-fold into fresh LB medium containing kanamycin and incubated as before until the cell density reached an $OD_{600}$ of 0.4-0.6. The culture was separated into 10 ml cultures, into sterile plastic 50 ml falcon tubes. These tubes were induced at varied concentrations of IPTG, 0 mM, 1 mM, 0.5 mM and 0.1 mM and incubated at either 28° C. for 18 h, 16° C. for 16 hours or 37° C. for 4 hours (FIGS. 3.4.A). The pellets were then collected and lysed with lysozyme (2 mg $ml^{-1}$ of lysis buffer 1: Tris-HCl 50 mM, NaCl 25 mM, 5% Glycerol, pH=7.4) for 2 h in ice. A small amount of the pellet was kept for further assessment of protein solubility by SDS-page. Following centrifugation to separate the crude lysate from cell debris, the lysate was subjected to SDS-gel electrophoresis. For each temperature, we had also included an uninduced control sample. The control would either have a very faint band, corresponding to the size of the band of interest, or it would not be present when compared to the induced samples. The faint band of uninduced samples could be a result of leaky expression, something that T7 promoters are known for. Levels of protein production were assessed visually comparing the size of the band in SDS page relating to the halogenase. Relative quantification of each band could be done using Odyssey Imaging studio.

Once the conditions that enabled good protein production for each member were identified, we scaled up accordingly, lysed the cells and performed NiNTA purification with increasing amounts of imidazole, to finally obtain relatively pure protein. The NiNTA purification was optimised accordingly for each individual construct, and details are in further chapters. The eluted fractions were subjected to SDS-gel electrophoresis to assess efficiency of IMAC purification and binding to NiNTA.

The best conditions for production were selected (in both cases optimal conditions were found to be 16° C. for 18 h, with 0.5 mM IPTG), resulted in good amounts of soluble protein (10 mg/L and 5.8 mg/L as a 120 KDa dimer of Dsg205 and Dsg701 60 kDa as a monomer respectively) (FIG. 9).

Assaying Halogenase Activity

A small selection of electron rich substrates were used as an initial assay of halogenase activity by Dsg205 and Dsg701, supplemented with the flavin reductase PrnF.

We tested both proteins in purified form (using no enzyme, boiled enzyme and acidified reactions as negative controls). PrnF was provided enabling the reduction of FAD to $FADH_2$. Both proteins showed halogenase activity.

Having confirmed activity we explored the activity of the new halogenases against substrates within a 600 member compound library. Activity was determined using an LC-MSMS assay.

We observed a previously unprecedented level of enzyme promiscuity with a diverse series of compounds being accepted as substrates at good levels of conversion. Our study revealed that Dsg205 and Dsg701 could halogenate 33 (FIG. 10) and 28 members of the library respectively (FIG. 11), with LC determined conversions ranging from 5 to 75%. These low conversions are also noteworthy as they reveal that these compounds are able to be accepted as substrates and represent a good starting point for future development. Analysis revealed that, for all but a few of these biotransformations, a single new peak could be seen in the LC trace, indicating that the reactions had predominantly proceeded regioselectively. The compounds that were accepted by the halogenases, and their relative conversion levels are shown in the following figure.

Conclusion

Two novel halogenases of eukaryotic origins have been identified from uncharacterised genomic deposits. These are Dsg205 from the small filamentous fungus *Trichoderma virens* and Dsg701 from the edible mushroom *Pleurotus ostreatus*. Both sequences had been deposited in public databases as hypothetical proteins. Both novel FDHs were predicted (using the in silico methodology developed during this project) to act on free substrates and that they could show a broad substrate tolerance based on the flexibility of the C-terminus in the structural models that we generated.

Both FDH genes were successful cloned and expressed in *E. coli* which resulted in good yields of soluble protein. We tested the purified proteins against 600 small molecules and we showed for the first time a remarkable substrate tolerance of these wild type enzymes. Dsg205 accepted 33 structurally different substrates, while Dsg701 has accepted 27. 15 of these substrates were both accepted by Dsg205 and Dsg701. We saw conversion with a wide range of substrates, with some of the conversions estimated as high as 75%, as in the case of 8-quinolamine. We have also demonstrated that these phylogenetically distant FDH variants, although they exhibit a natural flexibility, they seem to retain the regioselective halogenation character that makes these enzymes attractive for biocatalysis. Although our yields for the majority of the substrates are modest this represents an exceptionally good starting point for a halogenase enzyme.

To our knowledge this is the first demonstration of phylogenetically different FDHs with such a broad substrate range from the wild type enzymes. Previous studies have tried to engineer tryptophan halogenases PyrH and PrnA to accept non-indolic substrates such as kynurenine, anthranilamide and anthranilic acid with yields ranging from 19% to 76% conversion. We have shown moderate to high yields with the wild type enzymes against a broad range of structurally different substrates, with retention of regioselectivity and moderate yields. This represent a great starting point for protein engineering or directed evolution, to increase the conversions and enzyme stability. Furthermore, this directly shows that being the identification of the definitive loop FxxPxxSxG can help identify FDH variants that do not show significant similarity to know FDHs, even if the only information of those variants is that it might exist as an open reading frame.

Example 3: Dsg407 from the Cyanophage Syn10

At the beginning of this project, the only characterised (by others) flavin-dependent halogenases (FDHs) from eukaryotic organisms were Rdc2 from the fungus *Pochonia chlamydosporia* and ChlA from the slime mold Dictyostelium discoideum. All other studied FDHs have been identified from bacterial species and more specifically, from the phylum of actinobacteria. The discovery of Rdc2 was especially exciting as it revealed that eukaryotic genomes could potentially harbour variants of FDHs with enhanced substrate flexibility compared to bacterial FDHs, while retaining the regioselective manner of halogenation which makes them especially attractive.

We searched for FDH variants from uncharacterised deposits of organisms in other kingdoms of life, away from fungi and bacteria. During those searches, we came across variants from archaebacteria including halophiles, thermophiles and psychrophiles as well as from plants and even arthropods. The most surprising of all findings however, was of a group of hypothetical proteins of viral origins.

Viruses are notorious for their small genomes, selecting only for genes that are important for their persistence. Although small, viral genomes are capable of acquiring new genes through horizontal gene transfer and through transposable elements. Horizontal transfer very frequently occurs from the host to the virus but the opposite occurs very rarely. Although the viral genomes are flexible, they exhibit unique selection pressures against deleterious and unnecessary additions to their genomes, enabling their genomes to be as efficient and minimalistic as possible for survival. The possibility that viruses have evolved or obtained and retained modifying biosynthetic genes like halogenases, is extremely surprising and remarkable. Here, we discuss our findings with a halogenase from the cyanophage Syn10.

Sequence Analysis of Dsg407 from Syn10

The identified FDH variant from the cyanophage Syn10 was hypothetical protein CPUG_00131. We renamed this variant Dsg407. This phage was isolated in 1986 from the Gulf Stream (not by the authors of this invention), as a double stranded viral DNA. Interestingly enough, Dsg407 only shows low >48% sequence similarity to hypothetical proteins from various cyanophages like cyanophage P-TIM40, P-RIM44 and phages from metagenomic samples. Additionally, when aligned against known halogenases it shows a very low 30% similarity to PrnA which brings it to the twilight zone of sequence similarity (25%-35%). The monodechloroaminopyrrolnitrin halogenase PrnC aligned only locally around the FxxPxxSxG motif (19% query coverage) with 31% sequence identity for the aligned area. This clear variation from the known halogenases could be also seen when be performed a simple blastp alignment. This low similarity to other FDHs other than cyanophages putative sequences reflects a clear sequence variation in viral FDHs which perhaps could also signify structural and mechanistic variation of viral halogenases compared to fungal and bacterial halogenases.

We next sought to find if Dsg407 could have been hijacked from cyanobacteria or other marine microorganisms. We analysed all the available genomes of the synechococcales in order to extract potential halogenases. This search yielded 4 potential FDH sequences from cyanobacteria including *Phormidesmis priestleyi, Acaryochloris marina, Aphanocapsa montana* and *Prochloron didemni*, but none in *Synechococcus*, which is the host of Syn10. When we aligned the top hit of this search against Dsg407, we did not observe any significant similarity, with the local alignment covering only 41% between the two sequences and with a sequence identity of 29% for the aligned area. Same level of similarity was demonstrated for all other hits, showing that Dsg407 is very unlikely to have been hijacked by Syn10 from these organisms, unless extreme recombination, insertions and deletions were induced by viral purifying selection.

We next submitted both the cyanophage Syn10 genome as well as the genomes of the cyanobacteria *Acaryochloris marina* MBIC110117 and *Prochloron didemni* on antiSMASH, to identify potential gene clusters that these halogenases could fall in. As expected, cyanophage syn10 genome does not seem to organise its genes in gene clusters and therefore not a single gene cluster was identified in its 177103 bp genome. The cyanobacterial species were found to contain several gene clusters encoding for bacteriocin, ladderanes, lassopeptides and terpenes, but none of these gene clusters was found to harbour any of the identified halogenase genes.

When we performed split decomposition/branching analysis of Dsg407 with Multiple Sequence Alignment ($MSA_2$) we could see that Dsg407 had common ancestry with tryptophan halogenases as they are located in the same extended spitted cluster (FIG. 12). However, there is a clear evolutionary distance between Dsg407, the typical tryptophan halogenases and tryptophan halogenases that prefer to act on tryptophan containing peptides, which is reflected by a clear splitting between those three, into three subclusters. Our interpretation of this result was that Dsg407 could act on free substrates and that it would possibly need substrates that are structural analogues of indole or tryptophan, but not necessarily tryptophan like PrnA or coupled tryptophan to a peptide, like Krml.

We also generated a homology structural model of Dsg407 using Phyre2 (FIG. 13). We generated an intensive model, which uses all sequences exhibiting maximum sequence coverage (set threshold above 90%) and provides a pairwise distance alignment; this can then identify regions of no coverage and model them by the ab initio simplified physics tool of Poing, a function of Phyre2. Of our sequence, 494 amino acids (93% of our sequence) gave a 100% confidence to the model. When we compared our model against PrnA, we observed the same heavily helical structure that tryptophan halogenases have, with the pyramid and box shape. However, there is clearly a participation of more loops in the packing of the C-terminus in Dsg407, which could potentially reflect on more intense conformational changes upon substrate binding and perhaps a potentially more flexible substrate specificity than the typical tryptophan halogenases. Furthermore, we could identify the active site of the Dsg407 based on the presence of the FxxPxxSxG motif, as well as the co-factor binding site. It looks like the important residues in PrnA are also present in Dsg407, with slight rearrangements however, as several loops have been introduced possibly mediating conformational changes upon specific triggering.

Cloning and Purification of Dsg407

As with the other halogenases tested in this project, the ideal protein production conditions were determined to be when inducing at $OD_{600}$ of 0.4-0.6 with 0.5 mM IPTG and incubation for 16 hours at 16° C. These conditions seem to be common with all FDHs that we have identified, unrelated from which organism they originate. We used these conditions to scale up to 8 L of culture, which was lysed by sonication and subjected to immobilised metal affinity chromatography (IMAC) manually using biorad columns prepared with equilibrated Nickel resin (Thermos). After elution of our protein, and buffer exchange using PD10 desalting columns to remove the imidazole, we obtained a highly pure Dsg407 N-terminus 8×His tagged with excellent yields of 13 mg ml 1 (FIG. 14A and FIG. 14B).

We also sought to determine the oligomeric state of Dsg407. In order to be certain about the results, we decided to cleave the affinity tag from the N-terminus of the protein. After IMAC purification and buffer exchange to remove imidazole, we incubated the enzyme with a 1:10 ratio of Dsg407: Tobacco Etch nuclear-inclusion-α endopeptidase (TEV protease) in dialysis bag and incubated overnight at 4° C. It is important to highlight that buffer exchange to remove the imidazole from the sample is quite important for the TEV cleavage step, as we have noticed presence of imidazole in the sample leads to Dsg407 precipitation when the sample is left dialysing overnight. Once cleavage of the His-Tag was confirmed by SDS Gel against an undigested sample of Dsg407-$His^8$, we subjected the sample to a second IMAC purification step but this time, we collected the flowthrough which contained our cleaved Dsg407. The sample was then subjected to size exclusion chromatography with a column which had been previously calibrated with protein standards, using the same equilibration, and running method for Dsg407 and standard. The results clearly demonstrated that Dsg407 exists as a trimer, something that was also confirmed by crystallographic data obtained from the solved structure of the apoenzyme. Furthermore, size exclusion chromatography revealed a monodispersed homogeneous sample, demonstrating an excellent purification and protein sample quality (FIG. 15).

Dsg407 Against Library of 300 Compounds

Having demonstrated that it was possible to express dsg407 and obtain good quantities of pure and soluble protein, we wished to determine whether that enzyme had any activity as a halogenase. We used a master library as a test bed for probing halogenase activity. An LCMS-based approach was used for analysis of the assay; the assay conditions were modified for those used for Dsg205 and Dsg701. NaBr was used as the halogen source and Dsg407 was tested against a small subset of the master library. We observed bromination of some of those compounds.

An FDH iodinase has yet to be identified. The only known FDHs that has been discussed to be able to utilise iodine in vivo was the variant B brominase Bmp2 and the decarboxylating phenol brominase Bmp5. However, this activity has not been demonstrated in vitro. Specifically, in a publication that followed their initial discovery where the mechanism of these enzymes was tested in vitro, there has been no mention of iodinase activity for either enzymes[43]. Another discussed enzyme which could perhaps act as an iodinase is CalO3 from calicheamicin biosynthesis. However, there are no in vitro or in vivo experiments to our knowledge demonstrating such activity of CalO3.

Encouraged by our results with Dsg407 and NaBr, we also tested for NaI, as the incorporation of C—I bond would be a modification highly desirable and unprecedented from the toolkit of selective halogenating biocatalysts. Surprisingly, Dsg407 enzyme not only incorporated iodine to produce the corresponding iodinated products, but it showed a preference for iodine.

We immediately sought to test the full master library against Dsg407 with NaBr and NaI. For the assays we used 10 μM Dsg407, 1 μM PrnF, 1 μl of substrate (10 mg/ml), 10 μM FAD, 5 mM NADH and 10 mM NaBr or NaI in Hepes Buffer at pH=7.2. With Dsg205 and Dsg701, only 3 out of 300 compounds of the initial 300 compound library were halogenated. With Dsg407 10% of the library (30 compounds) were accepted as substrates of Dsg407. As with the other two halogenases, we repeated the assays with the positive hits at least in triplicate, including controls with boiled and acidified enzyme as well as absence of enzyme, as we wanted to be sure that halogenation is mediated by Dsg407, which was the case. We did not observe any halogenated products in the controls. Furthermore, we observed halogenation of the same products with both NaBr and NaI, however we got higher conversions with NaI, hinting that the enzyme prefers iodine.

Approximate conversions were calculated based on PDA peak areas of both substrate and halogenated product and do not take into account any change in extinction coefficient that may occur in halogenation. For the substrates accepted by Dsg407, we only observed a single new peak appearing after the starting material, indicating regioselective halogenation, although it is possible that minor regioisomers were not observable due to low conversions of several of the substrates. We only observed the presence of two new peaks in the case of 5-azaindole but after analysis of the starting material we determined that the starting material was contaminated with small traces of 6-azaindole, which is also a substrate of Dsg407 Furthermore, Dsg407 accepts D-tryptophan but not L-tryptophan, showing a degree of enantioselectivity which has not been seen previously with tryptophan halogenases. Most tryptophan halogenases act on L-tryptophan but can also accept D-tryptophan. Dsg407 also accepted complicated and exotic moieties like spiroindoles which were passed to us by our collaborator Professor Richard Taylor. These results together indicate a very strong substrate flexibility in combination with the unprecedented ability to incorporate C—I bonds in vitro. Additionally, we have shown that Dsg407 can accept a variety of heterocycles including N-, S-, and O-heterocycles. Finally, although our initial results show moderate conversion for most of the accepted substrates, it should be highlighted that Dsg407 is a wild type enzyme and the substrates that have been accepted are most possibly not the natural substrates. Therefore, these initial results are rather remarkable, considering that PrnA and other halogenases were engineered by directed evolution and rational design to expand their substrate scope and demonstrate yields from 15-65%.

Substrates Accepted by Dsg407

Having demonstrated Dsg407 halogenase activity in such a broad range of substrates, we sought to test if we could also show this activity with the crude lysate. Unsurprisingly, halogenation of these compounds can also proceed with the crude lysate, this result has been demonstrated with all FDHs investigated so far. Furthermore, by addition of 10-fold excess of the halogen salt of choice 100 mM NaI or 100 mM NaBr, the substrates can be selectively brominated or iodinated respectively. As a control we also prepared an empty vector lysate (pSG181 without dsg407 insert) from 100 ml of culture; this was used to determine whether the reaction could be promoted from any other components in the lysate. We saw that this was not the case.

Optimisation and pH Studies with Dsg407 Pure Enzyme

We sought to investigate if we could modify assay parameters for better conversions. As such, we tested various buffers including Hepes, Phosphate buffers, Tris-HCl at pH 7.2, however we did not observe any significant difference between these buffers. We next performed a pH screen, using some of the initial purified enzyme Dsg407 preps.

For the pH studies, the assay conditions were 10 μM Dsg407, 10 μM of FAD, 1 μl of substrate (10 mg/ml in DMSO), 10 mM of either NaBr, NaCl or NaI, 5 mM NADH, 1 μM of PrnF and 50 mM of the buffers mentioned above at the appropriate pH, in 96 well plates, at 100 μl assays. We used 6-azaindole as it gives good conversions with Dsg407. The reactions were all run in triplicate for all three halogen salts for 90 mins at 30° C. The workup was performed carefully using a precalibrated multichannel pipette, for comparable sample preparations. Both starting material and halogenated product were monitored at 335 nm using the PDA detector of the Waters UPLC system.

The results from the pH studies confirm that iodine is the preferred halide of Dsg407 as we can see that the conversions are significantly higher with this halogen. The highest conversions are achieved at pH=8 or in lower pH bellow 5.5 (FIG. 17). These results are remarkable, as it shows a pH flexibility which has not been demonstrated in any other FDHs.

Second and equally remarkable observation from the pH studies is that chlorination can occur in lower pH. There is a clear inhibition of chlorinating activity at pH >5. This behaviour was shown with all accepted substrates tested and therefore it is not only something that we are observing with 6-azaindole. Furthermore, when we repeated our usual controls (no halogenase and boiling of sample) we did not observe any chlorinated products, in presence of NaCl. Acidic conditions would protonate the pyridinic cation of 6-azaindole, making it less reactive, however this is exactly the point when halogenation occurs with Dsg407, which is the opposite of what would be expected to happen with chemical halogenation. Finally, bromination is stably occurring at all pH including pH 6, where neither iodination or chlorination proceeds. This final observation, together with the other two related to the other halogens is very intriguing and raises several important questions about the enzymatic mechanism of this enzyme, which requires both kinetic as well as structural investigation in order to start to understand.

Steady State Kinetics of Dsg407 and 6-Azaindole

We next sought to determine the kinetic constants of Dsg407 with the substrate 6-azaindole, at the optimal pH for chlorine, bromine and iodine. For iodine, we determined the kinetic parameters for both pH=3 and pH=8, as both of them showed high conversions. Initial rates were calculated based on substrate consumption, at 0, 2, 4 and 6 minutes and the substrate concentration was varied for the best fit for the Michaelis-Menten curve. All assays were run in 150 μl, in 96 well plates and the PrnF concentration was always in excess to ensure that production of the cofactor $FADH_2$ was not a limiting step. Assays were always performed at 30° C. and all assay components except the substrate and NADH were preincubated at 30° C. NADH was added the reaction started by addition of substrate and terminated with addition of formic acid. All assays were run in triplicate and the assay conditions were the same used for the pH studies, but instead we were using 15 μM PrnF.

| Enzyme | $K_{cat}$ (min$^{-1}$) | $K_M$ (μM) | $K_{cat}/K_M$ |
|---|---|---|---|
| Dsg407 (NaI, pH = 3) | 4.8 ± 0.6 | 35.3 ± 2.1 | 0.14 ± 0.07 |
| Dsg407 (NaI, pH = 8) | 5 ± 0.5 | 27.8 ± 1.6 | 0.17 ± 0.04 |
| Dsg407 (NaBr, pH = 7) | 2.4 ± 0.6 | 53.6 ± 3.2 | 0.04 ± 0.08 |
| Dsg407 (NaCl, pH = 3) | 4.4 ± 0.5 | 35.8 ± 4.3 | 0.12 ± 0.07 |
| PyrH | 2.5 ± 0.4 | 15.2 ± 4.2 | 0.16 ± 0.05 |
| PrnA | 1.1 ± 0.1 | 20.7 ± 0.1 | 0.05 ± 0.005 |
| RebH | 0.6 ± 0.1 | 18.7 ± 1.3 | 0.02 ± 0.004 |
| SttH | 1.7 ± 0.1 | 25.3 ± 3.2 | 0.07 ± 0.01 |
| Th-Hal (30° C.) | 4.3 ± 0.5 | 12.2 ± 1.8 | 0.35 ± 0.07 |

The results were compared with related FDHs including the tryptophan 5-halogenase PyrH, tryptophan 6-halogenase SttH and tryptophan 7-halogenases PrnA and RebH. By selecting halogenases with different regioselectivities, a better comparison of kinetic parameters for FDHs in this class can be obtained and shown.

The $k_{cat}$ values of Dsg407 with iodine and chlorine were found surprisingly found to be higher than any of the other tryptophan halogenases, which is rather surprising as we have not yet managed to obtain full conversion with 6-azaindole, whereas the tryptophan halogenases all reach full conversion. Dsg407 is found to be as fast if not more as the thermophilic halogenase Th-Hal when it acts as an iodinase and two times faster than PyrH. However, it is obvious that Dsg407 has almost two times higher $K_m$ compared to all the other FDHs compared showing that it has less high affinity for 6-azaindole compared to all other FDHs against their natural substrate tryptophan. Finally the ratio of $K_{cat}$ over $K_M$ showed that our enzyme acts better as an iodinase and especially at higher pH and significantly less good as a brominase, however the catalytic efficiency of Dsg407 compared to the Th-Hal is 2 times less, although it is significantly higher than most of the other FDHs compared in this study.

These results suggest that our assay needs further optimisation, as there could be several factor inhibiting our reaction and preventing our enzyme reaching optimal conversion. Furthermore, although we can confidently compare the kinetic parameters of Dsg407 against varied pH and halogen, our kinetic studies calculated initial rates based on substrate consumption whereas all other FDH parameters were determined based on product production.

This enzyme seems to have an ability to utilise all three halogens, with iodine functioning in both high and low pH but with a preference for higher pH and chlorine at lower pH, whereas bromine can be utilised stably at all pH, with lower kinetic parameters reflecting the significantly lower yields compared to iodine and chlorine, making it a remarkable halogenase with great potential for biotechnological applications.

FIG. 18C shows an X-ray crystal structure of the apoenzyme Dsg407 at 2.75 Å, after synchrotron radiation. The crystals were obtained using the hanging drop method in 2 μL (1:1 protein to reservoir ratio) at room temperature against 500 μL reservoir solution containing 0.1 M Tris HCl pH 8.5, 0.2 M magnesium chloride hexahydrate, 30% w/V polyethylene glycol 4,000 (FIG. 18.B). Molecular replacement was not straight forward, because of the low similarity to any structurally characterised FDHs. However with a combination of modelling building using PrnA and RebH and intensive refinement we have been able to determine that Dsg407 is a trimer (FIG. 18.D). Although the crystal packing showed an asymmetric hexamer, with a butterfly shape (FIG. 18.A), we showed that the biologically relevant oligomeric state is that of a trimer. More specifically, as shown by the homogeneity of the sample analysed by size exclusion chromatography, the sample that was crystallised was the catalytically active species, corresponding to 200-180 kDa which shows the trimer of Dsg407 (60 kDa as a monomer).

Both the solved structure and the homology model of Dsg407 (that we had previously generated), show that there is a higher loop participation in the overall structure. Interestingly, the overall structure seems to be more disordered than other FDHs. There are significant differences observed between the monomer of Dsg407 and other FDHs (apo structures) in the flavin binding pocket and the C-terminus, which are found to be significantly more mobile in Dsg407. The mobility of those areas is shown in the B-factor or Debye-Waller factor model, used to describe the attenuation of xray scattering caused by thermal motion in those areas (FIG. 19). The yellow areas correspond to the extensively more disordered areas.

All structurally characterised tryptophan halogenases tend to envelop the substrate by a tightly ordered C-terminus. In the case of Dsg407, the C-terminus has an increased loop content. Strangely, the characteristic helix which usually holds the C-terminus in tryptophan FDHs, is interrupted by several unusual loops showing a helical propensity. This structural behaviour could enable these loops to act as both loop but also as a helix. Furthermore, these areas are highly mobile in the B-factor map. This could reflect how Dsg407 can accommodate such diverse substrates, from small aromatics to complex spiroindoles.

Using the FxxPxxSxG motif (highlighted in green cylinders, FIG. 20) we were able to identify the loop separating the putative substrate binding site from the tunnel guiding the hypoalous acid. Furthermore, using multiple sequence alignment 1 ($MSA_1$) we were able to identify the putative conserved lysine residue which has been shown to be responsible for the regioselective halogenation, in other FDHs. When we located Lys79 it became apparent that it was in very close contact to Ser359, which is one of the conserved residues that we have found in the FxxPxxSxG motif. Specifically, we calculated the distance between these residues to be less than 2.5 Å. Previously this serine residue has been suggested to guide the hypoalous acid towards the lysine residue. This very short distance would make the hypoiodous acid or hypobromous or hypochlorous acid impossible to bind, as solely the ionic radius of iodine is 2.2 Å. This makes us postulate that the serine is there to block the Lys79 from reacting with the hypoalous acid before a certain stimulus is introduced, which could change the conformation and perhaps increase the distance between serine and lysine for the hypoalous acid to react with the lysine.

From the apo Dsg407 we cannot deduce much about the halogen binding site as the same residues that have been found to coordinate CI in tryptophan FDHs are also present in the apo structure. Although Dsg407 is 8 amino acids shorter than PrnA, it contains almost twice the amount of histidines and lysines. In combination with the higher proportion of loop content, pH might be a trigger for conformational changes which could enable chlorine to bind to the halogen binding site and enable it to participate in chlorination in lower pH. In pH above 5, a different conformation might not facilitate binding of chlorine. We ought however to consider that there could be a second halogen binding site, which has evolved to coordinate larger halogens such as bromine and iodine. However, this is a working hypothesis based on structural data and it needs further investigation in order to show exactly what is happening from a mechanistic point of view.

Finally, when facing the trimer from the frontal plane (FIG. 21) we could see that the trimer at the pore formed by the three monomers there is an extended loop connected to an a-helix. The residues of these loops are found in near the C-terminus of Dsg407. The extended loop is formed by Met427, Cys428, Asn429, Tyr430, Met431, Pro432, Glu433, Ser434, Met435, Gly436, Pro437, His438, Arg439, Gln 440. Specifically, the histidines and arginines of each monomer are oriented in such a way to face approximately 2-4 Å away from the same residues in the other monomers, bringing them in very close orientation from each other. It is very possible that these residues might contribute to the oligomeric assembly. Additionally, sensitivity of these residues to pH changes, might lead to conformational changes could contribute to the effect on chlorination on lower pH.

Conclusions with Viral FDH Dsg407

The viral halogenases is of particular interest as it showed a remarkable substrate tolerance against the initial 300 compound library. The two fungal halogenases halogenated 1% of the initial 300 compound library initially and we later developed a second hit-based which brought the number of hits up to 28-33. The viral halogenase Dsg407 however halogenated 10% of the initial 300 compound library (30 compounds), regioselectively, accepting even 3D substrates such as spiroindoles and thus going beyond the flat indolic structures that PrnA and other characterised halogenases show preference. More importantly, this enzyme is the first viral iodinase capable of also brominating and chlorinating in a pH dependent manner. A super-halogenase capable of incorporating all halogens (except fluorine) could provide the reason for a virus to keep it within its otherwise very minimal genome (FIG. 22).

We also determined kinetic parameters for this viral iodinase, at various pH against one of the non-native substrates that gave good yields, 6-azaindole. Steady state kinetics showed that iodination is the preferred activity of this enzyme and that it is a very competent biocatalyst when compared to other FDHs, the kinetic parameters of which have been shown against their natural substrate. There are several components of the assay that require further optimisation in order to explore the full biocatalytic capacity of this enzyme as we can see that there might be some limiting factors developing in our assay not enabling full conversion for the moment. A cofactor regeneration system and optimisation of enzyme stability for longer incubation times could greatly benefit the biotransformation. As with the other two halogenases, it is our most urgent goal to fully characterise most products possible to understand more about the regioselectivity of these halogenases. Furthermore, it would be very exciting to explore whether this halogenase could incorporate other pseudohalogens, including azides. Tentative experimental data (not included in this thesis) suggests that it may.

Dsg407 represents a game-changing enzyme in this area. From a fundamental viewpoint it is fascinating that a virus with a genome 170 kb with strong purifying selection against genes that are of no use to the virus, encodes a biosynthetic modifying enzyme like a halogenase. Dsg407 represents almost 1% of its genome. This virus infects *Synechococcus*, one of the most abundant photosynthesiser in the planet. Although there have been a few publications in recent years where various researchers have tried to understand the functions of these metabolic genes through comparative genomics and transcriptomics, to our knowledge no one has established activity in vitro. This work represents the first biochemical and structural characterisation of such a metabolic gene from a bacterial phage, found to be a halogenase and more excitingly an iodinase capable of incorporating also bromine and chlorine, in a variety of structures.

General Experimental

All chemicals and solvents were purchased from Sigma Aldrich UK, Alpha Aesar UK, Fisher UK, Fluorochem UK or Apollo Scientific Japan. All chemicals were used when specified under nitrogen either wise all reactions were performed in clean, air-dried glassware.

$^{1}$H NMR 500 MHZ, $^{13}$C NMR 126 MHz and $^{19}$F NMR 470 MHz were recorded on Bruker 500 or 400 instrument at the University of St Andrews. Deuterated NMR solvents were purchased from Sigma Aldrich or Cambridge Isotope Laboratories Inc. and contained ≥99.8% atom % deuterium. Chemical shifts (0) are listed in ppm relative to tetramethylsilane (TMS, δ=0.00) unless stated otherwise with all coupling constants J listed in Hz. High-resolution mass spectral (HRMS) analyses were acquired by electrospray ionisation (ESI), electron impact (EI) or chemical ionisation (CI) at the EPSRC National Mass Spectrometry Facility in Swansea University. Peaks are reported as m/z. TLC analysis was performed using Machery Nagel polyester backed sheets which were coated with silica 0.20 mm of thickness. Plates were using a model UVGL-58 MINERLIGHT® LAMP multiband UV-254/365 nm and/or by ninhydrin stain (50 mg of ninhydrin dissolved in 40 ml of acetone).

Evaporation of solvents was carried out on a Büchi Rotavapor® R-114 under reduced pressure. The pH of solutions was adjusted using a Fisherbrand Hydrus 300 PH meter with a two-point calibration (pH 4 and 7). Purified compounds were freeze-dried using an SCAVAC cool safe freeze-drier equipped with a Vacuubrand chemistry 158 hybrid pump RC6.

For the biological work, all chemical and biological reagents for buffers, media and stock solutions were purchased from commercial suppliers. No further purification took place and storage was according to the supplier's instructions. All microorganisms used in this work were stored at −80° C. for longer term storage. Biological work was carried under sterile conditions using either a Faster BH-EN class II vertical laminar airflow cabinet or a Bunsen flame. All surfaces, equipment and gloves were always disinfected with Distel (2% v/v). All microorganisms used in this work were stored at −80° C., in 700 μl of 50% glycerol in water combined with 300 μl of culture in sterilised 1.5 ml Eppendorf tubes. All media, buffers and glassware used for cultures were sterilised at 121° C. for 20 minutes in a Boxer Benchtop Denley autoclave prior to use. Pipetting of solutions and samples was done using LABNET Biopette autovclavable pipettes. pH measurements were taken using a Fisherbrand Hydrus 300 pH meter.

Standard UPLC Conditions

Samples were analysed by UHPLC using a Waters Acquity UHPLC system equipped with a Waters Acquity BEH $C_{18}$ 1.7 μm 2.1×50 mm column at 40° C. An injection volume of 5 μl was always used for all samples. The analytes were eluted using an initial solvent composition of 90% solvent A (0.1% TFA in water) and 10% solvent B (Acetonitrile) at a flow rate of 600 μL/min that was held for 0.5 mins. This was followed by a linear gradient to 95% solvent B over 1.5 minutes. This solvent composition was held for 0.9 mins before returning to initial conditions over 0.1 mins. The initial conditions were held for 1 minute before the next sample was injected. The elution was monitored by UV absorption or fluorescence response tuned to appropriate wavelengths.

Standard LCMS Conditions

Samples were analysed by a LC-HRMS2 using a Thermo Orbitrap Velop Pro system, equipped with a Waters Xbridge $C_{18}$ µm 2.1×100 mm column at 40° C. An injection volume of 5 µl was used for all samples. Analytes were eluted using an initial solvent composition of 90% water & 0.1% formic acid (solvent A) and 10% acetonitrile (solvent B) at a flow rate of 0.35 ml/min. This initial solvent composition was held for 1.5 mins followed by a linear gradient to 95% solvent B over 8 mins. This composition was held for another 2 minutes before returning to initial conditions over 0.5 mins. The eluted analyte was passed through a PDA detector monitoring absorbance at 220-800 nm (2 nm resolution, 10 Hz) and a valve which diverted eluted analyte to the waste. After the first minute, the valve was switched to pass the eluted analyte through to the inlet valve of the H-ESI source. The H-ESI source was set to positive ionisation mode using a 300° C. heater temperature, 350° C. capillary temperature, 50 U sheath gas flow, 20 U aux gas flow, 2 U sweep gas flow, 3.5 kV ionization voltage and 50% RF lens power. The scan cycle included one high-resolution survey scan and three data-dependent fragmentation scans. The survey scan was analysed in the orbitrap FTMS analyser at a resolution of 30,000 (at 400 m/z) over a range of 100-2000 m/z, based on a background ion corresponding to the $[M+H]^+$ charge state of n-butyl-benzenesulfonamide (exact mass 214.08963) as a lock-mass for internal scan-by-scan calibration. The top three peaks from that scan, were then identified, isolated and subsequently fragmented under the CID (collision-induced dissociation) or HCD (higher energy collisional dissociation) modes at 35% normalized energy before fragments were analysed in the standard resolution ITMS analyser (CID) or high-resolution FTMS analyser (HCD).

General Experimental Procedures & Equipment for Molecular Biology

Reagents, enzymes, media components, buffers, and solvents were obtained from Sigma Aldrich, Alfa Aesar, Fisher, Formedium, Promega or Thermos Scientific. Microbial culturing was performed under sterile conditions maintained using a Faster BH-EN class II vertical laminar airflow cabinet or under a Bunsen flame. *E. coli* strains were stored at −80° C. in 20% glycerol. Sterilisation was performed by autoclaving at 121° C. for 20 minutes unless otherwise stated, or by passage through a 0.2 µm syringe filter. Primers were synthesised by Sigma Aldrich at 0.1 mmol scale and purified by desalting by the manufacturer. Synthetic genes were purchased from Invitrogen. DNA sequencing was performed by GATC Biotech. Melting temperatures (Tm) of primers was calculated using Thermo Fisher Multiple Primer Analyzer under default settings, considering only the annealing region of the primer. Restriction enzymes, DNA modifying enzymes, DNA polymerases, and DNA purification kits were used according to the manufacturer's instructions unless otherwise described.

Microbial cultures were incubated in New Brunswick Scientific I26 or I26R, Innova 4300, 44 or 42, or Stuart SI500 orbital incubator shakers or a Genlab static incubator. pH measurements were taken using a Fisherbrand Hydrus 300 pH meter. 18 MΩ water was generated using an ELGA Purelab Flex system fitted with 0.2 µm point-of-use filter. Autoclaving was performed using a Boxer Benchtop Denley autoclave. Pipetting was performed using LABNET Biopette or Eppendorf Xplorer pipettes, externally calibrated biennially by Starlab. Centrifugation was carried out using a Fisher Scientific accuSpin microcentrifuge, Thermo Scientific IEX CL30R centrifuge with T41 swinging bucket rotor, or Beckman JXN-26 centriguge with JS 5.3, JA 25.50, or JLA 8.100 rotors. PCR was performed using a Biorad T100 thermocycler. UV spectra were obtained using a BMG LABTECH FLUOstar OMEGA microplate reader using clear flat-bottomed 96-well plates or a quartz L-Vis plate. Electroporation was performed using a Bio-Rad Micropulser™. Sonication was performed using a Bandelin Sonoplus instrument with KE76 and MS73 flat titanium tips. Automated protein purification was performed using an GE Healthcare AKTA Pure FPLC (fast protein liquid chromatography) system equipped with GE Healthcare HiLoad 16/600 Superdex 75 µg or 200 pg columns; HPLC, UPLC, and LCMS were performed using equipment described in the chemical experimental procedures.

General in Silico Procedures

DNA sequences were obtained from either the EMBL-EBI (European bioinformatics institute) or the NCBI GenBank nucleotide database (National Center for Biotechnology Information). For halogenase sifting PHI-Blast was used against non-redundant protein sequences (nr). The BLAST software used to search for protein sequence homologues of known halogenases was either the NCBI blastp software using the non-redundant protein sequences database (nr) or the SIB BLAST Network Service (Swiss Institute of Bioinformatics). Multiple sequence alignments were performed either using ClustalW2 software (EMBL-EBI), MUSCLE (EMBL-EBI) or CLQ workbench. DNA sequences were translated into protein sequences using the ExPASy translate tool (Swiss institute bioinformatics). Branching analysis and phylogenetic trees were generated with CLQ workbench (Qiagen). Split decomposition was generated with SplitsTree software (Mathematisch-Naturwissnschaftiliche fakultat). Protein secondary structure was predicted using the online PSIPRED predictor from the Bloomsbury Centre for Bioinformatics from University College London. Homology models were generated using PHYRE2 Protein Fold server. Restriction endonuclease sites within nucleotide sequences were identified with NEBcutter software V2.0 (New England Biolabs). The theoretical melting temperatures (Tm) of PCR primer oligos were calculated using the Biomath Tm calculator (Promega); base-stacking melting temperatures were calculated under PCR master mix conditions adjusting for Mg2+ concentration (1.5 mM). Protein pl and extinction coefficient were calculated by ProtParam (expasy).

General Gene Synthesis

Genes were synthesised as linear DNA fragments, designed by reverse translation from a protein sequence. The sequence was codon optimised for expression in *E. coli* using the online Invitrogen GeneArt tools. Restriction sides aside from those that were used from cloning were removed during design. A glycine residue was introduced after starter methionine, respective to the N-end rule, to increase protein half-life. Genes were cloned into appropriate vectors and the full-length sequence was confirmed by DNA sequencing before doing any further work. For easy cloning into pUC19, 25-30 bp of pUC19 MCS regions were added at the 5' and 3'-prime end of each synthetic gene.

Easy Cloning of Synthetic Genes (Strings) into pUC19

The cost of string synthesis is significantly lower than insertion into a vector by a supplier. In addition, the quantities of the synthetic gene can be a limiting factor for traditional restriction digest and ligation cloning into a vector. A template of 25-30 bp, identical to pUC19 MCS were added as flanking regions to the synthetic gene, allowing it to act as a primer in a PCR-amplification of the target plasmid, including restriction sites for EcoRI, NdeI.

For the vector preparation, all components were mixed on ice, in 50 μl reactions containing 37 μl sterile water, 5 μl 10× buffer E (Promega), 5 μl pUC19 (100 ng/μl), 1.5 μl of EcoRI, 1.5 μl of HindIII. The mixture was incubated at 37° cover night or until complete digestion monitored by gel electrophoresis. In the reaction mixture, 1 μL of FastAP alkaline phosphatase (Thermo) was added and was further incubated for 60 mins. The mixture was purified with PCR clean up kit (Promega) and the product was analysed by agarose gel electrophoresis.

Once the vectors had been prepared, PCR amplification was performed. The following were mixed on ice in 100 μL reactions that were later divided into 4×25 μl aliquots. The components included 67 μl of sterile water, 20 μl of 5× Phusion HF buffer, 2 μl of pUC19 (digested by EcoRI/HindIII, FastAP treated) as 5-20 ng/μL, 2 μl of synthetic gene as 50 ng/μl in sterile water, 8 μl of dNTPs (2.5 mM stock) and 1 μl of Phusion DNA polymerase. In parallel a negative control was prepared and analysed which did not include synthetic gene. The PCR conditions included 30 sec of 98° C. as an initial denaturation step, followed by 30 cycles of denaturation for 15 sec at 98° C., gradient annealing temperature from 60-72° C. for 30 sec and an extension for 3 min at 72° C. After completion of the 30 cycles, PCR was extended for 10 mins at 72° C. and the samples were held at 12° C.

After completion of PCR, 0.5 μL of DpnI were added into each PCR reaction and the mixtures were again incubated at 37° C. overnight. 5 μl of each reaction and control were mixed together (control separately) and 5 μl of this mixture was used to transform 100 μl of chemically competent DH10B-T1 cells.

Optimisation of Production Under T7lac Promoter

A 10 ml LB culture of *E. coli* BL21 cells (shortly before transformed with plasmid of choice under the control of T7 promoter) was used to inoculate fresh 10 ml LB cultures (X16) with appropriate antibiotic in sterile 50 ml falcon tubes and incubated with shaking (37° C., 180 rpm) until an of $OD_{600}$ of 0.4-0.6 (around 2 hours). Once this point was met, the tubes were divided and incubated for 10 mins in various temperatures (16° C., 28° C. and 37° C.). For each temperature, three out of four cultures were induced with either 1 mM, 0.5 or 0.1 mM IPTG (isopropyl-β-D-1-thiogalactopyranoside) final concentration, as well as no IPTG control for comparison when the T7 promoter was not induced. The cultures were left for 16 h at 16° C., 16 h at 28° C. and 4 more hours at 37° C. Following this, cells were harvested by centrifugation (using JLA 8.1000 rotor, 2000 g, 20 min, 4° C.) and frozen at −80° C. for at least 12 hours.

The pellets were lysed using chemical cell lysis and the lysates were then subjected to batch nickel purification (in 1.5 ml eppendorf tubes) by centrifugation. The lysates were equilibrated with nickel resin (Promega) using NINTA buffer 1 (Sodium Phosphate 20 mM, Sodium Chloride 300 mM, 10 mM imidazole pH=7.4), followed by washing twice with NiNTA buffer 2 (Sodium Phosphate 20 mM, Sodium Chloride 300 mM, 25 mM imidazole pH=7.4) and finally eluting twice with NiNTA buffer 3 (Sodium Phosphate 20 mM, Sodium Chloride 300 mM, 250 mM imidazole pH=7.4). Pellet, lysate and samples from batch nickel purification were kept and analysed by SDS electrophoresis.

Culturing for Protein Production with Shaking Flasks for Dsg205, Dsg701 and Dsg407.

The plasmid harbouring the gene of interest was always pre-transformed fresh into BL21 (DE3) competent cells. A single colony was picked from the transformation plate and was used to inoculate a 10-mL culture in LB containing kanamycin, which was incubated overnight (37° C., 200 rpm). If more than 10 mL starter culture was needed for following steps, then multiple cultures were prepared and combined after overnight incubation. The starter culture was diluted 100-fold with fresh LB containing kanamycin and was then incubated (37° C., 200 rpm) until it reached an $OD_{600}$ of 0.4-0.6. The culture was then incubated at the temperature of protein production (typically 16° C.) with shaking at 200 rpm for 10 minutes. Once the incubator had reached the desired temperature, the appropriate amount of IPTG (0.5 mM) was added to the culture and was further incubated for another 16 h. Following this, cells were harvested by centrifugation (using JLA 8.1000 rotor, 2000 g, 20 min, 4° C.) and frozen at −80° C. for at least 12 hours.

Chemical Cell Lysis

For small scale cultures (<200 ml), sonication was not necessary, instead chemical cell lysis is more appropriate for such volumes. A pellet of cells was re-suspended in 0.1 vol of chemical lysis buffer (including 2 mg of lysozyme/ml of buffer used). If NINTA purification was not to follow downstream, additional EDTA could also be added. The suspension was incubated on ice in the cold room (4° C.) for 1 h. Once a viscous solution could be observed, the sample was passed several times through a G23 gauge needle to loosen the mixture and the suspension was centrifuged to separate lysate from cell debris (16000 g, 20 mins, 4° C.). The supernatant was analysed straight away or stored at −80° C.

Cell Lysis by Sonication

Frozen pellets were thawed in a room temperature water bath until pellet had liquified and were transferred on ice and gently resuspended in lysis buffer (40 ml/L of culture). The portions of cell suspension were subjected to sonication on ice using the KE 76 titanium tapered tip was used for volumes of 100 ml of suspension per time, sonicating each sample for 2 cycles of 6 min at 40% power and 20% duty cycle. Samples were cooled on ice for at least 10 min between cycles. Cell lysate containing the protein of interest was harvested by centrifugation twice (using JA 25.50 rotor, 35,000 g, 45 min, 4° C.) and the supernatant was either subjected to further purification steps or aliquoted and frozen in liquid nitrogen for storage at −80° C.

Removal of Imidazole During Binding Step

It is important to highlight that the column should only be loaded with 2.5 ml (MAX) of sample. Therefore, if the previous step has yielded more than 2.5 ml, the elution fractions should either be concentrated (if the protein is not too sensitive in higher concentrations) or multiple PD10 columns should be used. If the sample is less than 2.5 ml, add some storage buffer to the sample to a final volume of 2.5 ml.

Before sample application the column was equilibrated (with gravity protocol) using step additions of storage buffer (5 ml)×4 times. The flow though was discarded.

Once this step was completed and the column was equilibrated, 2.5 ml of the sample were loaded to the column and was left to bind the column until no more flow though was coming off the column. The flow though was discarded.

For elution of our protein, a 15 ml sterile falcon tube was placed carefully under the column. 3.5 ml of storage buffer were added and eluate was collected the protein concentration was calculated.

TEV Cleavage of Histidine Terminal Tag

After IMAC purification and buffer exchange (very important to include buffer exchange step to remove imidazole, as most of the FDHs used in this study precipitate overnight with increased concentration of imidazole) the protein and TEV were mixed in a 10:1 ratio (protein:TEV) and added in dialysis tubing. For a 10 ml of protein sample, 3 L of NiNTA lysis buffer were prepared. The dialysis bag containing the protein and TEV were added to the buffer and left dialysing in the cold room overnight with gentle stirring. For assessment of the efficiency of the his-tag cleavage, a small aliquot of the TEV/Protein sample was analysed with SDS against an aliquot of the uncleaved protein. Once the protein was completely digested by TEV protease, the protein sample was subjected to a second IMAC purification. The flowthrough was collected and analysed further, as it contained the his-tag cleaved protein.

Size Exclusion Chromatography

After NiNTA IMAC purification, the protein sample was concentrated to 5 mL using Merck Milipore Amicon® Ultra-15 10 kDa MWCO centrifugal filters and subjected to gel filtration using the GE AKTA pure FPLC system, typically equipped with the GE HiLoad 16/600 Superdex 200 pg column equilibrated and eluted with GF buffer, monitoring elution by UV absorbance at 280 nm. In a typical purification, the injection loop was washed with 5 volumes of GF buffer and the first 40 mL of eluate following injection were discarded. After this, the eluate was collected in fractions of 3 mL over an appropriate fractionation range for the protein of interest. Fractions containing the protein of interest were pooled, concentrated by ultracentrifugation or subjected to buffer exchange into Storage Buffer (as above) if necessary, aliquoted and frozen in liquid nitrogen for storage at −80° C.

Flavin-Reductase Assays

Flavin reductase enzyme PrnF was IMAC purified from cultures of *E. coli* BL21 RG-5066. Flavin reductase enzyme solution (1 μM) was added to an assay containing NADH (200 μM), FAD (30 μM), NaCl (50 mM), Tris-HCl (20 mM, pH 7.5) in a total volume of 1 ml. The PrnF enzyme was added half way through the time course and the decreasing absorbance of the assay was followed at 340 nm over either 20 or 30 minutes, corresponding to the oxidation of NADH. An assay containing no FAD was used as a blank.

Halogenation Assays Using Pure Dsg205

$His_8$-Dsg205 enzyme was purified from cultures of *E. coli* BL21 DSG205. 100 μl reactions were carried out using Ni-NTA purified Dsg205 and PrnF enzymes using a range of substrates from the initial 300 compound library or the "hit guided library" (10 mg/ml stock solutions in DMSO) with appropriate controls. 10 μM Dsg205, 1 μl of substrate (10 mg/ml), 10 mM NaCl, 1 μM PrnF, 5 mM NADH and HEPES buffer pH=7.2. For a full 96 well plate a 10 ml mastermix was prepared, which contained everything but NADH and the substrate. Each substrate was added to a specific position in the well using a multichannel pipette. The mastermix was added in a sterile plastic container and was added in each well of the plate. NADH was added last in each well. The plate was sealed with gas permeable tubing and the reactions were incubated at 30° C. for 90 minutes. Equal volumes methanol and were added to quench the reactions and plates were centrifuged for 1 h. The samples were analysed either by UPLC or LCMS method.

Halogenation Assays Using Crude Lysate Containing Dsg205

The same procedure was followed for assays with crude lysate of Dsg205, as with pure protein, but this time the enzyme was not purified, it was used directly after lysis or after the lysate had been flash frozen in droplets and stored at −80° C. The conditions included 100 μl of crude lysate containing also 1 μM PrnF, 5 mM NADH, 10 mM NaCl and 1 μl of the substrates (initial 300 compound library or hit guided library). The reactions were left incubating for 12 hours. Equal volumes methanol and were added to quench the reactions and plates were centrifuged for 1 h. The samples were analysed either by UPLC or LCMS method.

Halogenation Assays Using Pure Dsg701

$His_8$-Dsg701 enzyme was purified from cultures of *E. coli* BL21 DSG701. 100 μl reactions were carried out using Ni-NTA purified Dsg701 and PrnF enzymes using a range of substrates from the initial 300 compound library or the "hit guided library" (10 mg/ml stock solutions in DMSO) with appropriate controls. 10 μM Dsg701, 1 μl of substrate (10 mg/ml), 10 mM NaBr, 1 μM PrnF, 5 mM NADH and HEPES buffer pH=7.2. For a full 96 well plate a 10 ml mastermix was prepared, which contained everything but NADH and the substrate. Each substrate was added to a specific position in the well using a multichannel pipette. The mastermix was added in a sterile plastic container and was added in each well of the plate. NADH was added last in each well. The plate was sealed with gas permeable tubing and the reactions were incubated at 30° C. for 90 minutes. Equal volumes methanol and were added to quench the reactions and plates were centrifuged for 1 h. The samples were analysed either by UPLC or LCMS method.

Halogenation Assays Using Crude Lysate Containing Dsg701

The same procedure was followed for assays with crude lysate of Dsg701, as with pure protein, but this time the enzyme was not purified, it was used directly after lysis or after the lysate had been flash frozen in droplets and stored at −80° C. The conditions included 100 μl of crude lysate containing also 1 μM PrnF, 5 mM NADH, 10 mM NaBr and 1 μl of the substrates (initial 300 compound library or hit guided library). The reactions were left incubating for 12 hours. Equal volumes methanol and were added to quench the reactions and plates were centrifuged for 1 h. The samples were analysed either by UPLC or LCMS method.

Halogenation Assays Using Pure Dsg407

$His_8$-Dsg407 enzyme was purified from cultures of *E. coli* BL21 DSG407. 100 μl reactions were carried out using Ni-NTA purified Dsg407 and PrnF enzymes using a range of substrates from the initial 300 compound library (10 mg/ml stock solutions in DMSO) with appropriate controls. 10 μM Dsg407, 1 μl of substrate (10 mg/ml), 10 mM NaX (X=Cl, Br, I), 10 μM PrnF, 5 mM NADH and either a) 50 mM citric acid buffer at pH 3 for NaCl, b) 50 mM bicene at pH 8 for NaI or c) 50 mM HEPES at pH 7.4 for NaBr. For a full 96 well plate a 10 ml mastermix was prepared, which contained everything but NADH and the substrate. Each substrate was added to a specific position in the well using a multichannel pipette. The mastermix was added in a sterile plastic container and was added in each well of the plate. NADH was added last in each well. The plate was sealed with gas permeable tubing and the reactions were incubated at 30° C. for 90 minutes. Equal volumes methanol and were added to quench the reactions and plates were centrifuged for 1 h. The samples were analysed either by UPLC or LCMS method.

Halogenation Assays Using Crude Lysate Containing Dsg407

The same procedure was followed for assays with crude lysate of Dsg407, as with pure protein, but this time the enzyme was not purified, it was used directly after lysis or after the lysate had been flash frozen in droplets and stored at −80° C. It is important to note that the lysis buffer should contain the appropriate halogen salt at the appropriate pH. The conditions included 100 μl of crude lysate containing also 1 μM PrnF, 5 mM NADH, 10 mM halogen salt and 1 μl of the substrates (initial 300 compound library or hit guided library). The reactions were left incubating for 12 hours. Equal volumes methanol and were added to quench the reactions and plates were centrifuged for 1 h. The samples were analysed either by UPLC or LCMS method.

pH Screening for Dsg407

For the pH studies, the assay conditions were 10 μM Dsg407, 10 μM of FAD, 1 μl of substrate (10 mg/ml in DMSO), 10 mM of either NaBr, NaCl or NaI, 5 mM NADH, 10 μM of PrnF and 50 mM of the following buffers: a) for pH ranging between 7.5 to 9 we used 50 mM Bicene buffer b) for pH ranging between 5.8 to 7.5 we used sodium phosphate ($NaH_2PO_4$) buffer and c) for lower pH ranging from 3 to 5.8 we used citric acid-sodium citrate buffer. The assays were run in 96 well plates, at 100 μl assays. 1 μl of 6-azaindole was used (1 mg/ml stock in DMSO). The reactions were all run in triplicate for all three halogen salts for 90 mins at 30° C. The workup was performed carefully using a precalibrated multichannel pipette, for comparable sample preparations. Equal volumes methanol and were added to quench the reactions and plates were centrifuged for 1 h. The samples were analysed either by UPLC or LCMS method. Both starting material and halogenated product were monitored at 335 nm using the PDA detector of the Waters UPLC system.

SEQUENCE LISTING (237 sequences)

SEQ ID NO: 1 - protein, 34 aa, Artificial Sequence
  Consensus
  MISC_FEATURE (2)..(11): This region may encompass 0-10 residues
  SITE (2)..(11): Any amino acid
  MISC_FEATURE (13)..(22): This region may encompass 0-10 residues
  SITE (13)..(22): Any amino acid
  MISC_FEATURE (24)..(33): This region may encompass 0-10 residues
  SITE (24)..(33): Any amino acid
FXXXXXXXXXXPXXXXXXXXXXSXXXXXXXXXXG

SEQ ID NO: 2 - protein, 9 aa, Artificial Sequence
  Consensus
  SITE (2)..(3): Any amino acid
  SITE (5)..(6): Any amino acid
  SITE (8)..(8): Any amino acid
FXXPXXSXG

SEQ ID NO: 3 - protein, 6 aa, Artificial Sequence
  Consensus
  SITE (2)..(2): Any amino acid
  SITE (4)..(5): Any amino acid
GXGXXG

SEQ ID NO: 4 - protein, 6 aa, Artificial Sequence
  Consensus
  SITE (2)..(2): Any amino acid
  SITE (4)..(4): Any amino acid
WXWXIP

SEQ ID NO: 5 - protein, 519 aa, Trichoderma virens
MAIPEKCTVLVVGGGPAGSYAAAALAREGIDTVILEADKFPRYHIGESMLASMRHFLRFIDVDSVFDSYGFTKKVGAAFKLNPKKREGYTDFLAAGGPENYAWNVVRSEADQLLFQHAAKSGAKAFDGVQVKSINFIDVPYKGPGQLPHDYPGRPVSATYVQKDDNTPREIKFDYIIDASGRVGILSTKHLKNRKYNQGLKNVATWGYWKGAGAYGKGTPRENSPFFEALQDESGWAWLIPLHNGTASVGIVMNQKMSVERKTQAGSPDSKTFYLDCLKELAPDLTKLMENGELITDIKSAADYSYSASGYAIPYARIAGDAGCFIDPYFSSGVHLAFVGGLSAAATIAAAIRGDCSEEAAADWHSKKIADAYIRFLLVVLSAYRQIRSQEEPVLSDINEDNFDRAFAFFRPVIQGIADVDTKLSQDELRKTLEFCSNAFEPVKPEDRTAMLEKLGKDPATAYQVDLSDQQRTVVDHIRARQMMRTEDTININSFGTDSINGFVPNLKRGELGLVPAKV

SEQ ID NO: 6 - protein, 574 aa, Pleurotus ostreatus
MASSTQPYTQPPKHVNVLIIGGGPAGTYAASALAREGIEVAVFEASKFPRYHIGESLIPSVRHYLRFIGAEEKLANHGFCRKPGSAIKFNQNKQEGYTDFVALGHNNNAWNVVRSEFDQMLMNHARSSGAAVYERTKVNSIEFSKSNPGRPTSVSWTHTPPPVPLSPPTSPQTKFKKLESNGDASEETSQVVEGVTTFDYMIDATGRAGIMSTKYLQNRRFNESLKNVAVWGYWENVGTYGVGTKREGAPWFEALTDETGWAWFIPLHNGTTSVGIVMNQKSHTDRTKQQVATGDGSSTMTSRYLENILLAPGLVDLIGEGKMVDGTVKSASDFSYSAPKYAGERYRIVGDAGAFIDPFFSSGIHLAMTSALAASASICASIRKDCTELEATEWHTKRVATSYTRFQVVVLSAYKQMRAQNFDVLSEIDEDNYDRAFAYLRPVIQGASEMGARLSEDELQRSLDFCLQLFNPTSPEQHERVFKQGGALARQLMDLSQPVMDTSLLLQQIKPLCGRRESPDTSEDSDSDVELVVKKINARRVVHPEYAINNLETEPLEGFAVRLERGNLGLIGKH

SEQ ID NO: 7 - protein, 530 aa, Cyanophage Syn10
MKIESVAIVGGGSSGWMTAAALSKLCPQLEIALIEDPNIKTVGVGESTLGHFNKFLHLLDLKDEDWMPACNATYKNSIRFTNFREGKGEVFEYPFGPSLDVSFFSQTDGINTWGKLANKYPEDFPPETFARFVNSNTYLAEHNRLTRNKDNKIPNFNFDWDTAYHIDAELFGQYLKEKIALPNGVKHIQGKVTGYQKESPNNHNFKYIILDQETAIFADLYIDCTGFKSLLLGEFMGEAFSPFSKKLANDKAMATRIPYENREEEMHNVTDCHAMKNGWVWNIPLWNRIGTGYCYSSRFVSKDDAEAEFREHLGERGKDAKIFHIDIGHGKRTRAWVNNCVGIGLSYGFIEPLESTGLLTTHENIENLVYLINQRDGYVTQAERDGFNYTCDHQIDSFSDFVAMHYAYSMRTDTPYWKWCTQMCNYMPESMGPHRQKQSTWQDLSTDTIGLNTWHINHNGISFIIAGHGLRPQSYDKLSEVLLKRNNESDYYYEDIRKDWLKHYESMVEYVKTLPTHYEFLRDEIYGSAE

SEQ ID NO: 8 - protein, 399 aa, campylobacter phage CP21
MKVTVIGKGTAGILTTKSLRFNFPDLEIDWIYPESNKFIGVGEALVPASSKFLKTIGVDNKMILKDFRGSIKAGLKMIGWADKTFNLPFDNSVLLNRYMNKDLFPENFINFENVSHHFNTFSLQNLYVENINNINKTVTSFKDIDSDLIVDCRGFQDSDDFIEPGILKNNIALTTRIPVQNFLNPYSSFFARDFGWCWTIPLQDYISIGYVTNDSFINQASEDLKKHLQENFKTDLKDYNTIKFKTGYKKQQIAKIEGHNVFSVGLNAAFVEPLQSTGLWLASQQIQELINYIKNGDTNWNQRFEDMYNRVYQFILNHFILCKKSNEYWDYYKNFNFKDSLFTGSNGNNVFDGEFENFLYDSFQGKSVKYNIDKNIVGGKAALTKLKKFDELLRDYLSK

SEQ ID NO: 9 - protein, 983 aa, Oidiodendron maius
MSVPDTCTVLVVGGGPAGSFAAAALARDGIDVVLVDADKFPRYHIGESMLPSIRHFLKFIDCDDKWINHGFIKKKGAAFKLNWTQPDAYTDFIAAAGPNGYAWNVIRSESDEILFKHAGECGAHIFDATKIESINFVEDAETKEAWDSDLPNPGRPVSAIWARKDGSTGLIAFKYLIDASGRQGISSTKYLKNRKFNQSLKNIANWGYWTGAGVYGVGTHKEGSPYFEALKDASGWCWFIPLHDGTVSVGIVQNQEQATAKKRAQGSPSSKDFYLNSLDLVPGVKALCGQGTLVSDIKSASDWSYTASSYAFPYARIIGDAGCFIDPFFSSGVHLAILGGLSAAVTIAGSMRGDCDEKTAALWHSKKITESYTRFFLVVSSALKQIRSQEEPVINDIDEEGFQRAFDLFKPVIQGTVDADSNGRFTQADISKAMEFCFKAFTHVTPEEKDALVEKLKSYGLDARADDESTQKAIDEIEKNLTAEELQVLNILRSRRMVREDGYNIDSFTLDAVDGLSPNMVRGKLGLKKAESVKLNISNLYSIDYLEGKTPGVRVPNSQDSSKESMNGHGLNEHSNGIENSMKEGITGSVNGSMRNGTPATREELEGMVKLITPLNNFGSAMDDLHRHALMSALYQAAESLETPFDTLMRFSNSRYQLSLIKVGYQLGVFEALVASSAALTAEELAKHTGADPKLVSRVVRYLAANRIIVELGENLYEANKITKYMADPHMEGGMKYFHTVSSPTVHKLPEFLQENNFQNPIGEPSVWHKSKNTAMNLFAWLKANQPETLKHLHNLRAFPKERNWLSCIPFAQFSETDRIAFVGMGRNVEHECLRLKEAHPKLAGRIVLQHLPETPQHAPMIKDVTFISHDIFTPQPVKGAQYYYLRRTLHHWSDEQVVEILRNLVPAMALDSQVLIDEIVLPNTAASAPPAAHDLEMMIMFGAMERTINQWNVLLDHAGLKAVEVKTYEIAMQSSIIFAQLK

SEQ ID NO: 10 - protein, 500 aa, Unknown
  Description of Unknown: Candidatus pelagibacter
MSVNKITVLGGGTAGLVSALVLKARFEKLNIEVVKSDNIGIIGVGEGSTEHWKDFMEFIGVPLKELLLETDATFKYGIMFEDWTKEPYFHNITNELHKVALGQYYAGYAYATINKLKPDEYTSGHCFNNEVLPNYIPSQFHFNTHKLNTFLLKKCKDFGIEVHTDDITDVETDNHGIKRIRGDKGWYESDFYIDCTGFKKYLISKLGAKWVSYKDYLPMNEAIAFPTPDTDEYTPYTLAKAMSSGWMWRIPTYGRWGNGYVFDNRYINAEQAQKECEDYLGFKVNVAKNIKFDAGALDRPWIGNCVAMGLCASFIEPLEASSIGTSIQQSFLLMHTLINYKQTDIDQYNTKVGHIVENIRDFVLLHYIVKRNDSKFWKELKVNLPDSLKHNLDKWSDRMPIKEDFKTDYVLFNAQNFAVLLKELELANIDSLKREYDMLVEHNKNVVKKEVDHHIKTFKTDPMNKQCPIMGHKQYLMKLRSGKETLNQQIDYLQNENSNT

SEQ ID NO: 11 - protein, 511 aa, Unknown
  Description of Unknown: Eukaryarchaeota archaeon
MKIKNVCIVGGGTTGWMMAVALNVNVPNLKVTLVESEEIPSIGVGEATIPLTAKFISSVLKFDEKEWMAASDATYKTAIRFNNFSKIDESFWHPFWSDDEIHYNTYDWLIKRQIEDLPTEDFYKSNFIAWYMSMDKRFQEIKGFQHAHHMDANKFARYCQTQFKGTHINATVSSVEEKDGYIKSITVDGKKIKSDLFIDCTGFNALLIGETLNEPYTSYEDTLLNDSALVCRIPYGNDPFTNRQQECHPFTDCTALSSGWVFNTPVWSRTGTGYVYSSKFQSREDAEQEFRIYLVDRFGGDRGDIAEFRHISFKTGKYERSWVNNCLALTLASGFIEPLESTGLALACWQIENFIDVLKDDDMSSFIRATYNDKVNMAYDEIHTFIAMHYANTKREDTEYWKHIKNNLHITQKMVDYAKNDNVPDIWFPKKSRECVLIGLDIPSEYSKQHITWHGENFESIMKSDDNEKEFMTAGVQYLNGRKNMYQSISNDMPWHEDYLKEHIHVESEDS

SEQ ID NO: 12 - protein, 493 aa, Unknown
  Description of Unknown: Verrucomicrobia bacterium
MSSKNKKLIVLGGGTAGWLTALFLNKIFPKYETTLIESKQVGIIGVGEATTPNIIYMLDYLNINLSELISETKGSIKNGINFENWNGDGKKYFHGFYERLADFSVPPIFKGDCWNHYLNNLISKKLDFNTHTYITKLSYENKVDVHKTSYALHFDTNLLSEYLHKTGVDRGIKYVNGKLKKVHSSNLNDNINKITLTNNKSYSCDFIFDCSGFSRLLIGKHFGVKWKSYKQHLPMKKAIPFWLKQTGNIQPYTTALAMKYGWIWKIPLQHRIGSGYIFDSNYINDDQALKEAEKTLNTKLEVNKIIDFEAGRYESFWHENCIALGLASSFIEPLESTSIFLTIQQLFNLNHFLGDMFKENKNSKALYNEMSNKNMDETLNFVYLHYLTKRNDSPFWKNFRKDYPPPTNFRHVLSLIRSGNLRFLDIEEVKKTAAFPISSYLMVAYGLGLFNKKPNMIYYKNIVPTISQYLDAIKQATDQATPLNIFLDHVNYK

SEQ ID NO: 13 - protein, 541 aa, Sclerotinia borealis
MSVPTQTSVLVVGGGPAGSYAASLLGREGVDVVLLEADKFPRYHVGESMLASMRFFLRFIDLEKTFDDHGFEKKFGATFKITTKKEAYTDFAASLGKGGHSWNVVRSESDELLFKHAGKSGAKTFDQTKVDSLQFEPYSRDRFTAEDHLANPGRPVSAAWSRKDGTSGTINFDYLIDGSGRNGIISTKYLKNRRFNEGLKNIAIWSYWKGAERYKQGEDNENSPFFEALTDGSGWVWAIPLHNGTLSVGIAARQDFFFERKKTSKLEGKAFYTEYLDLAPGIQQLLKNAEIVSELKQASDWSYSASAYAGPHFRIIGDAGCFVDPYFSSGVHLALTSGLSAAISVQAARRGQADEWSAAKWHTTKVSEGYTRFLLLVMTVLRQLRMKEAHLITTEQEEGFDMAFKKIQPVIQGVADTETDDARVQKNAAEAVDFSLDSFEVTPEKQRAVIDKIEKAQTAPETLEKLTPEEVHILGGIVTRTFEREKDELNLTSFTGDVIEGLSANLVRGDLGLIRKGKKTVTPETTATMEMLAVESIKSVA

SEQ ID NO: 14 - protein, 554 aa, Unknown
  Description of Unknown: Euryarchaeota archaeon
MKVEEPDHFIEFENFDPYKGKIESVVIVGGGSSGWMTAAALAKLCPHLEVALVESKDIKTIGVGESTLGHFNQYLELLDLKDEDWMPHADATYKNGIQFTNFREGKEEVFQYPFYTDYDLTYAPQGINTWAHLANMFPKDFPPESFAEFYCANTFLCNENKQTRNFDNVVRQFDFRRHTAYHLDATKFGIYLRDHICLPNGVQHILGEITGFQTMYEKPNDQTISYLVMDGINAIQADLFIDCTGFKSKLLGGFQGIPFIPAENKLANDKAWAVRIPYEEETREKEMRNVTDCWAMKNGWTWDIPLWNRIGKGYVYSSRFCRKESAKQEFIKHLRHTVGKKRADAAELFHIDIEHGRRQRAWVNNVVGIGLSYGFVEPLESTGLLTTHENILRLVTTLNQRDGYVTRTEKEGFNWICNYTLDNFIDFVAMHYAFSMRTDTPYWRWCTQQNFYNPESVTQNVPVHQSIEQFVSSTLGEGWHPNMNGIPFIAAGHGIKSSSYLKRTQYLLGELMADTDHLEDKRKKYLQWKEYIEKYVAQLPSHYEFLRDEIYGTP

SEQ ID NO: 15 - protein, 537 aa, Unknown
  Description of Unknown: Euryarchaeota archaeon
MRVESIVIVGGGSSGWMAAAMLSKTFPKMQIGLIESEQGPIGVGESTLGHFNRFLKRLGLKDKDWMSYCNATYKTSIAFKNFRHGEGERFQYPFGEFDLFDYKDTLQRYFELGCKYGVDKYPPDEFANFANNQTYLADQCKISADPIPECTYDMDRDTAYHFDAGLFGNYLRDHHCIPNGVMHLKGEIEKVMKNPDGSIDSLVTTQDGLIKADLYIDCTGFKSLLLEQHMGSEFISFKDKLFNDTALATQIPYSDRENQMETYTDCVAMNAGWVWNIPLWHRVGTGYVYSSDYINECEAEVEFRKYLSERYTPEIAQDAKLRKINIKHGKHEKAWVKNVVGIGLAYGFLEPLESTGLMTTHENILLLCDTLQRRQGFYSRFEQDSFNYNCDNMIESMKNFVALHYALSQRDDNKYWRDCTNINFDIDPLWKQSTRVAHSNVVTMLDNLEDAFYNLEQHSGSIYIAAGQGYRPFSEGMFEERMSADKESDEWSSILEEIHTKYQQDRKIMMEWVDKLPSHYEYLRDNIYDLQEEETVG

SEQ ID NO: 16 - protein, 368 aa, Gaeumannomyces tritici
MASVPQSCTVLVVGGGPGGSYASAALAREGIDVVLLESEKFPRYHIGESMLPSMRHFLKFIDGYEKFNAHGFNIKKGGAFRLNWARPESYTDFVAAGGPEGYAWNVVRSEADEIMFKHAASCGVKTFDATKVTSVEFSPPSSPEEELGRPVSATWSRKDGSSGAISFRYLVDASGRAGLLSTKYMKNRHYNQGLKNVASWAYWKGGGTHAVGTHKEGAPYFEALKDASGWVWFIPLHNGTHSVGVVQNQDIATEKKRAMAEPSARGLYEQSLDLVPGIRALLSKAEMVSDVKSASDWSYSASRYALPGARIVGDAGSFIDPFFSSGVHLALAGGLAAATTIAAVLRGDCDEATAASWAPPTPTLRVAA

SEQ ID NO: 17 - protein, 581 aa, Armillaria ostoyae
MHDNRLWVFLEHWCLLFWPACRSRYTSYLSPPIPYITRKNLAISIQQLIVNRLWFQLNAMIPTKTTVLVVGGGPGGSYAAAVLARENVDVVILEADKFPRYHVGESQLAALRHFLRFIDLEKEFDAYGFQRKVGGAFKLNRHKREGYSDFISHDPKNYSWHVIRSESDELMLRYASRVGAKVFEETKVTDIEFGTPVEGQETRPVAALWKGKNGDTGRIQFDYIIDASGRTGILSTQYLKNREFNNKLMNVAFWGYWTGAGRYMAGTPREDSIFVEALTDETGWVWFIPLHDGTTSVGVVMDQEKSNLMRAAVKEARGDSSSSAHYLRQLELAPAIRELMVDAKLIKKPDAPLVSSASDYSYAARYHAGPGYRIIGDAGAFIDPFFSSGVHLAVSGGLSAAATICAVMKGECSELDAARWHTTKLNSSYTRFMLVVLSAYHQIRSQDSPILSAQEDDNFDLAFEFFRPIIQGNTESGGKFADDNLGKTIDFLGKHVFEPSYPEQRAELVALYGDQLDAVPKARVPGDNEAKAETKTILKHMAVQKLIRMEDVAHIGNYVSDVFEGHRLRLKRGELGLDKAA

SEQ ID NO: 18 - protein, 516 aa, Gymnopus luxurians
MASTHTSTIPATATVLIIGGGPGGSYAAAVLAREGINVLLLEADKFPRYHVGESQLASLRHFLRFIDLEKEFENHGFTQKHGAAFKLDKHKREGYTDFVFDDPKNYSWNTVRSESDELMLRHAARSGATVIEETRVMEIEWDDARPMAATWKNTQSGQMGQVKFDYLIDASGRAGICSVKYLKNRHYNPDFKNVAFWTYWSGCGEYKPGTSRAGSPYFEALSDESGWAWFIPLHIGTSVGVVVKQELSDEKRATAKTRGLDSSLYGHYMRLLDSAPNIKAMIANAAIIKNNNEIVVRTASDYSYHSDSYAGPHYRIIGDAGAFIDPYLSSGVHLAISSGLSAAASICSSLKGECSEDDAIRFHNAKIDASYTRFVLIIKSVYEHIRSQKATTLSSATEDNFDDAFLMFRPVIQGRIDSSLSLSEEDKTRLVHFYSRHAFEPSMPEERHNLLKEFGDPVKSFNNADDIHSKAILRSMAVRKLLSVDETNHIDNYVADVVEGFRLRLERGNIGIEKCR

SEQ ID NO: 19 - protein, 521 aa, Mycena chlorophos
MSVPASAKVLVIGGGPGGSYAATCLARENVDVVLLEADKFPRYHVGESQLASLRYFLRFVDLEQQFEDFGFQKKPGAAFKLNQNKREGYTDFTAKDPANYSWNLVRSLSDELMLRHAAKSGANVIEETKVTEVEFKGEGDAAQPVAAVWKNKAGETGKITFDFVIDASGRNGIISSKYKKTRVFNDNLLNVASWGYWKGTGRYAVGTSRENGPFFESLTDESGWAWFIPLHDGTTSVGVVQNQDISNKKRAEAKERGEDSSTSAHYHRELDLAPAVRVLMGEATMVKKPDAPMISAASDYSYHASAYAGPHYRLVGDAACFIDPFFSSGVHLAISGGLSAAASVCAVINGQATDAEAQVYHHQKVDAAYKRFLLVVLSAYQQIRVQNVPVYSNENNFDEAFHFFRPIIQGNTDTGKQLAGDDLKKTVEFLGTHAFEPSLPEERTQIFAKYGEEVDKLPPSMTDDNVEDTRARNILQGIAIRKLMRTEDTLHINNETVDILGGLRMVMKRGSLGLEKAEVMA

SEQ ID NO: 20 - protein, 492 aa, Pseudoalteromonas byunsanensis
MTATLINQAYNKHHKLVDIRLIESPDVDIIGVGEATVPAIKDFLQAAGIDEAEFMNYCNATFKNGIMFENWRQPKHGKMHRYVHPFDFERVEKRLDIATSWVLSERQRPFDESVSLASTLIQHNLTPKTRTTKPYHGIVHYSYHMDARLFGQFLRQRAMAAGVTRIEAHVESVNTDNGQISSIATTQGLFESDLFIDCTGFRALLISALEEKSSNWRSYQDELMCDSAVTVQIPHSEEHIPRSYTVAHALSCGWAWSIDLQNRTGNGYVYSSKYCSKEQAELEFRNYLKLDNNVALNHIDMSVGRRKRHWIGNCVAIGLAGGFIEPLESTGLHLIFLAARFLVLHNNFQYCEANIAGFNQTMNATYDELKDFIVTHYVLSDRDDSDFWRDISKTLDACPQLAQKLDLWQSKVCEFFDVSNSTSHMFTDTSYRYILFGMDHIPQIKIPYFDGEFTDVFEFVKSRQQKAVAIALNHVDYFSYDVKGQVTVKLSQ

SEQ ID NO: 21 - protein, 507 aa, Unknown
  Description of Unknown: Gammaproteobacteria bacterium
MPQKAIKTLVIVGGGSAGWMSASFLNHIFNLKEKQIDIKLIESSEVETIGVGEATIHSIRFFLSTIGISEREFMQKTQAIFKHGILFKDWSGQEKDEYYHPFEHPKVNDGIDVVRHWVNLNSNTEKSSRFDFSVSAQSLCASQNKSPKSQGNKDFEGYFPYGYHLDAAKFAHFLRDFSLTKGVKRIEGHVQEVILGTDGDIQRLILKNGLQIDGDFFIDCTGFSSVLMKAMGNKEWVDYSDSLLCDRAVTCQLEHNKENQEHRPYTIATAQKSGWIWDIDLQSRRGMGYVYSSSFCSTEQAEIDLSVYANTAREKLSFKHLQMKTGRMEKIWFKNCLAIGLSAGFIEPLESTGIYFIDMGIRFFGDYITSGNVNTLLIDKYNTVMGQLMDQSKDFISLHYTLSKRNDSQFWRAYQHDVPISETLSANLTLWKHKIPTAIDFSAQITQFTSANYTYILYGMKYFPEPAVTSNLFTSEDRSMKNIEYVKSRSNQMNNKLPTMSQFLKNI

SEQ ID NO: 22 - protein, 498 aa, Asticcacaulis sp.
MFMNSVQQQEIVILGGGAAGWIAAALLARKTDRSQTRVTLVESEEIGIIGVGEATVPVLAHCNALLGIDEYDFIRNTQGTFKLGIEFCDWGVAGNRHFHAFSDYGHQVDGVSTHHYWLRLRQSGDAHPIDDYSFAYAVAKNNNFAPTDPQNPRYHHAYHFDAALYARYLRDVATGQGVQRIEGKMTHFDLESASGNITAIHLANGSRVPGDLFLDCTGFASELLGKALETPFVDWSRWLLCNSAMAVPSKRTGAPMPFTRSTAHAGGWRWTIPLQHRCGHGMVYNSDLWSDDAARDALTGNVDGELLAEPRVFRFTSGHRKQFWNRNCVGIGFASSFLEPLESTGLQLIVQGVLKLLQFFPQRIIDPVLRDEYNRISTREIERIRDFIIAHYYLSRRPEPLWAACRNIEVPDSLRHKLEVWNASGQIALGDLESYMEPSWLAILLGNGVVPARYAVAADLYPLEQIRKGMKLRREEIVRSAQAVTSHQDFIDQYCKAP

SEQ ID NO: 23 - protein, 516 aa, Marinomonas mediterranea
MKKRIAIIGAGLSGIAAIKQLTDEGHHVVCYEKAESFGGVFAAKKIYEDLHLTISNYFMAYSDFLPTEQSLKFWSKQEYVQYLKRYLAHFDIEKHIVYNHKVVNAEQNGDKWTVKVQSGSGEETESEFDMVVVCSGHFQEPKTPDLEGLSDFMGDIIHSNDYRDKMAFKGKRVMCVGLGESSADITSEISEVAEKCILSLRRYPAVAPRYMAFQEDPYFTIDTSWLTSRIVNKLPFSYHRGITKNIFHKYVNSRNLHLRIRGEWLHKSGPSIHQAVTKNERLFKPIAEGKVLPNIGGIERFEGNTVIFKDGTHEEIDAIVFCTGYKLSFPFLQHKIECMRDLYKQIFIPSVGSSLAFVGFVRPQQGGIPVIAEMQSRYLAQLASGVKSLPSLEKQKEVIMEDANHWETEYHITPHVASLVNYCHYMDSMARLVGCMPKTPSLLKDPLLRVKLLHNPQFAAQYRLEGPHPMSESSRDFLVNFPNISTWPRIIHFECALAMQKLLSFLSMDNLRELKK

SEQ ID NO: 24 - protein, 522 aa, Armillaria solidipes
MIPTKTAVLVVGGGPGGSYAAAVLARENVDVVVLEADKFPRYHVGESQLAALRHFLRFIDLEKEFDAYGFQRKVGGAFKLNRHKREGYSDFISHDPKNYSWHVIRSESDELMLRYASRVGAKVFEETKVTDIEFGTPVEGQETRPVAALWKGKDGDTGRIQFDYIIDASGRTGILSTQYLKNREFNNKLMNVAFWGYWTGAGRYMAGTPREDSIFVEALTDETGWVWFIPLHDGTTSVGVVMDQEKSNLMRATVKEARGDSSSSAHYLRQLELAPAIRELMVDAKLIKKPDAPLVSSASDYSYAARYHAGPGYRIIGDAGAFIDPFFSSGVHLAVSGGLSAAATICAVMKGECSELDAARWHTTKLHSSYTRFMLVVLSAYHQIRSQDSPILSAQEDDNFDLAFEFFRPIIQGNTESGSKFADDNLGKTIEFLGKHVFEPSYPEQRAELVALYGDQLDAVPKARVPGDNEAKAETKTILKHMAVQKLIRMEDVAHIRNYVSDVFEGHRLRLKRGELGLDKAA

SEQ ID NO: 25 - protein, 528 aa, Colletotrichum higginsianum
MSPAIPERCTVLVIGGGPGGSYAASALAREGIDVVVLEGDKFPRYHIGESMLASMRHMLRFIDLEAKFDSYGFIKKPGASFKLNKDKRPGYTDFLAAGGPNNYAWNVVRSEADQLMFHHAGECGAKIFDAVKIKSIRFEDATTVPEGEPNLNPGRPVAAVYEVAETKETGEIAFDYVVDASGRVGLLSTKYMKNRRYNQGLKNVANWGYWEGCNKFSPGTPRENSPFFEALTDESGWAWFIPLHNGKASVGVVMNQKLAAHKKQQGGFNSTEFYHESLKLAPELLSVLVGDGKFVSDVKSASDYSYSASSYAFPNARIVGDAGCFIDPFFSSGVHIALTGALSAATTIAASIRGDSEEATAAEWHSKKVAAAYTRFLLVVLSAYKQMRFQGDPVLSDFDEDNFDRAFSFFRPIIQGTADAANGNLSQDELNKTLEFCAHAFEPVNPEANQEKVMKAVSAAPAGSDYNPDLSVEEQNAVNHIRARKMMRTEDTFNINTFGTDSIVGYVPNLVRGSLGLKKAETNGVVAA

SEQ ID NO: 26 - protein, 527 aa, Suillus luteus
MAGQTLPTSTQILIVGGGPAGSYAAAALAREGFEVTLLEAVQFPRYHIGESLLPSVRHFLAFIGAEESIMNYGFTVKPGAAVKLNQFKREGYTDFVALNPNNGSWNVIRSEFDDLLFRHASNSGATVFDNTRVTEFQFEGERPVSASWRNAITGVEGRISFSYLVDASGRNGIMSTKYLKNRRYNKALNNVACWGYWDGTGSYMPGTTRENAIFVEALKDESGWAWFIPLHDGSTSVGIVMDSESSNRKKKASRAASGGSGSNILAHYKEELLSRAPGVLKLIGTATLRNDGTPEAVKSASDFSYSAPSYAGDHFRLAGDSGAFIDPFFSSGVHLAFTGGLSAALTIAASIRGFCSEEDAQRWHTSKIATSYTRFLLVVLGTYKQIRNQAMPVMSDVDEDNFDRAFDLIRPVIQGTADVGKALTEDELQKTMDFCRHLFAPTNPEMHSAVKARLDPSLTSPDAPVMTESDIDSLLGDADEEAKLVLSEINARKPIHTMYNPTENFGVEAHFGFKAVLERGKLGLAST

SEQ ID NO: 27 - protein, 524 aa, Streptomyces glaucescens
MSMRKSVCVIGAGPSGLVAIKELLDEGHSVTCFEHSAELGGVFRAEVGADEAGAYDSTMLTISNYMMTFSSFPPPQGQDRRYWSAGEYRQYLLDFAEKFGLGPAIRYRTDVLSVSRNDSGGYTVEVAPVDDPEGRAAHQFDAVVISTGTHRVPNYIDLPGQEEFAGEIVHSAHYRNADRFRGKRVLCVGIGETAADVVNEIAQVAASCTLSVRRYQPIVERYPGDRPFTNDAYTSHLLHSVPLAAAGPLMHLGMKRNRTRGKTAAARAVAAWNANNPDFFHHFLTKNDAFVHRIVDGTLTVDASGIQRLGKDYVVFRSGRRETIDTVMLNTGYTEDFSILKDVDVTDVRRLYKHMIHPELGTGVVFIGWARPAAGGVPACSEMQSRYFALLCSGKKKLPDRVRLQGLIERQAAYENEVFHGNPDLRTLVHYNHYMIDFAKVIGCSPWRPSLLLDPRLALRLWCGSQTPHVYRLSGPHSDRRTARRTVMSLPPAFTPAQIALTTAVSAVSRVLIRLGLMKADPVY

SEQ ID NO: 28 - protein, 531 aa, Moritella viscosa
MSKRIIMQTQQKNICVIGAGCSGLVAIKELLDEGHQVTCFETLDKPGGNFYCSDNVEISGSYDSTMLTISNYMMAYSSYPPALSEQRKFWSAREYQEYLLDFTKHFSLDQHITYENAVNNVKKLDNGKFHVDVRSTHDETQVSSFTFDAIAVCTGSSRVPKYIDIKGLETFKGDVYHSAFYKNSKPYTGRSALCIGMGETGVDVASEIAGVAGKCMLSLRQRQPSVERFPLAKEHPSDAYTSHFLYAMPVSAGNARMKLQFKAMKKFGKEEKTRAFADWNLKAGNYFNYFNLKSDVFVDRIVDNKMAVNTSGIDYLGEDYVAFNDGHKESIDMIMLNTGYTDKFDFLEDIKLPDMRQLYKHMIHPDLGCDIVFIGWARPAVGGVPACSEMQSRYFALLCSGKKQLPEMHKLKQLIAQQAFYEDEVYFKNRNVRSLVHYTGYMADFSKVIGCSPWRLSTFLNPILTYRLWVGSQMPSFYRLYGPHSNYDKAKKSIFNVPIAFNLIEAAVLTTYTLLTRGLATLGIIKADPKY

SEQ ID NO: 29 - protein, 1013 aa, Chaetomium globosum
MSIPQSCTVLVVGGGPAGSFASAALAREGIDVVMLEADKHPRYHIGESMLPSMRHFLEFIDCYEQFNAHGFIKKNGAAFRLNKTQPEAFTDFIAAGGPNGHAWNVVRSEADELLFNHAASCGVRAFQTTKVDAVQFEESDGETAGPGRPVSASWKRKDGTTGTIAFKYMVDASGRYGLLSTKYLKNRKFNQSLKNIANWAYWKGGGIYAEGTHKAGSPFFEALQDASGWCWFIPLHDGTHSIGIVQNQEMATEKKRAAGSPSTKEFYTQSLDLAPGIKALLSKAEVVSDVKSASDWSYSADTYAFPYARIAGDAGAFIDPFFSSGVHLAVLGGVSAAVTIAASIRGDCDEKAAASWHSKKTAESYTRFFLVVSSALKQIRMQEDPVIQDLDEEGFQRAFDLFRPVIQGTVDAHHNGKLTQSEISNTVEFCFKAFTHVTPEQKDAVVNKLRKLSANAEAGDEETIDNALGEIEKSLTPDELQVLNILRGRRMIREDGYNMDSFTLDTIDGLAPRMERGKLGLAKSQAARLSKAHLYSADYLEGKRPGVRVVQPAKSMNGANGHSNGEANGHTNAANGTNGVNGANGTNGHTKEHANGHENGSGMNGAAKATFNAANGAGLFASPINGQAAQLDDVGRHALMNTLHEAAENLETPFDLVMRLGNSARLLTYIRVAHTLNLFATLSNASPTPVPLTTLTSTGPAPGAAPTFIRRVLVFLAANRLIGEAGPDLFVATKATHSLALPGVAGGATFYQGVIAPMTQYLPESPLAKCGYVQRAGEPAVFDSWSAGVEGGGRGLWPYLKGRPEMLGAFQELMALDRGGGDWVGCVDFEGVDSPSLVMGGEGGGGSERVVFVDVGGNVGHQARRLVERHPRLAGRVVVQDLPETVAAAPAAKGVAFLAHDFFEPQPVRGARYYYLRSVLHNWGDAQAVEILKNVAAAMVEDSRVLIDEMVVPDKSADVLVAGQDLNMMLLFGGMERRTDDWAALLDRVGLKIVEVKMYGPVTKNSIIVAMLK

SEQ ID NO: 30 - protein, 971 aa, Pseudomassariella vexata
MIATIPEKCTVLVVGGGPAGSYAASALAREGIDVVLLEADKFPRYHIGESMLPSMRHFLKFIDAYEKWDAYGFNIKKGGAFRLNWSRPETYTDFVAAGGPGGYAWNVVRSEADELLFKHAAECGVKTFDETKVASIEFAEPASSDSQNFGRPVSATWTRKDGTTGTISLDYVVDASGRAGLISTKYLKNRSYNQGSKNIASWGYWKGGGVHGVGTFKEGAPYFEALKDGSGWVWFIPLHNGKHSVGIVQNQEMATKKKREMAEPSSAGFYKQSLELVPGIKELLANAELVSDIKSASDWSYSASSYAFPGVRIAGDAGSFIDPFFSSGVHLALSGGLSSATTIAAAIRGDCNEEKAASWHDKKTAESYTRFLVVVSSALKQIRSQDQPIINDFDEQSFERAFDLFRPIIQGQVDADARGKLSQAEISKTVEFCFKAFAHVSFEEKEALIAKLKQLGLDGDAYDESNRAALDAIEKKLTAEEQSILKTLKGRRMVRPEDSLNIDNFTLDSIDGLAPRLERGRLGLQGAKKAQVKFTAHDSLSFLNGEARAANKLQNGHAAANGTGHANDHANGHASDHANGHANGHSDIHGVEKSLVDLVMSEERLPSASLDESSRHRLMSSLHESAEELETPYDTMLRFVNAGRQVALIKIGGDLGIFKSLADSKTPLCSTQLAEGTGADPTLFSRIMRYLVANRLVAEVSPDHYVARKTTHALADPRIESPMRFFHAVSNPAFQALPDFLRETGYQNQTQRQALQKGLGTELGLFPWLKQRPDLLRDFQSLMGVPKEGNCLDVIPLDDSVCSGHKGPVFVDIGGNTGQQAGGLVAKYPALAGRVVVQDRQETVNSATGVKGVQFMAHDFFSPQPVKGAKYYYLRAVLHNWDDDKAAQILANIVPAMSADSLVLIDEVIMPDMGAHVWPAGLDLQMYTLFGASERTAKQWDALLQRAGLQPVSVKKYAPVMGSSVIFAAPK

SEQ ID NO: 31 - protein, 961 aa, Ophiocordyceps australis
MASIPEKCTVLVIGGGPAGSFASSALAREGINVVLLEAEKFPRYHIGESMLPSMRHFLKFIDCYEKWDAHGFNIKNGGAFRLNWSRPETYTDFIAAGGSQGYAWNVVRSEADELLFKHAGECGVKTFDETKVASIEFAPREADAPEKQPFGRPVSATWTRKDGSSGVIAVDYIVDASGRNGLISTRYLKNRAYNQGLKNIANWGYWKGGGVHGVGTFKEGAPYFEALKDASGWVWFIPLHNGTHSVGIVQNQEMATAKKRKMAEPSSKGFYLETLELVPGIKELLAKAELVSEIKSASDWSYSASNYAFPGVRIAGDAGSFIDPFFSSGVHLALSGGLSAATTICAALRGDCDEKFAASWHDKKTAESYTRFLVVVSSALKQIRAQDQPVINDFDEDTFERAFDLFRPIIQGQADSDFKGKLSQAEISKTVEFCFKAFAHVSYEDKEALVKKLKDLGLDGDAHDEKNRQALDELEKKLTPEERSILTTLKGRRMVRPEDSLNIDNFTLDSIDGFAPRLERGRLGLASAEKAKVKYTTHDSLSYLNGEARAANKVPANGAVVKNGCNGANGHHAANGVNGSANKNMAALVADDENLPQTTLDEASRHKLMSSLHESAEQLETPYDTMLRFLNAGRQVALIKLGGDMQIFKSLVDSKTPLSSAQLAKPTAADPRLVARIVRYLAANRLVAQVAPDQFTAQQTTHTLADPRIQGPMRFFHAVSNPAFHALPDFLQETGYQNKSETCAFQRGLKTDLGLFPWLKQHPDLLKDFQSLMGVPKEGNCLNVISLDASVSSEHRGPILVDIGGNTGQQAGNILAKHPELAGRVVVQDREEAVKNASDIKGCQFMAHDFFKPQPIKGAKYYYLRAILHNWDDEKAAQILANIVPAMTADSLVLIDETVIADEGAHVWPAGLDLQMFTLFGATERTTTQWDAILDRAGLRPVAVKRYAPVMGSSVIFAAPK

SEQ ID NO: 32 - protein, 1016 aa, Colletotrichum sublineola
MASVPQSCTVLVVGGGPAGSYASAALAREGIDVVLLEAEKFPRYHIGESMLPSMRHFLKFIDGYEKWDAHGFNVKKGGAFRLNWSRPETYTDFIAAGGPDGYAWNVIRSEADELLFKHAAECGVKTFDATKVTSIEFSSPGEGSEADGKKLGRPVSATWSRKDGSSGTISFDYLVDASGRAGLISTKYLKNRSFNQGLKNIASWAYWKGGGVHGVGTHKEGAPYFEALKDASGWVWFIPLHNGTHSVGIVQNQEMATKKKREMDEPSSLGFYKQSLDLVPGIKELLSKAEMVSEVKSASDWSYSASSYAFPGVRIAGDAGSFIDPFFSSGVHLALSGGLSAAASIAAAIRGDCDEETAASWHDKKTAESYTRFLVVVSSALKQIRSSDQPVLHDFDEESFERAFDLFRPGTFPVARGMKKFNQHSLTLYRPAVIQGQVDADTKGGLTQAEISKTLEFCFKAFAHVSFEEKEALVNKLKELGLDGDAYDETNRQALDELEQKLTPEEQAILKTLKGRRMVRPEDSLNIDNFTLDSIDGLAPRLERGKLGLAPAKKAQVKYTTHDKLSYLNGEAGAANKLESNGHHKPQGNPTVTNGHGATNGHSATNGHSATNGHSATNGHSMTNGHNGVTEHTSYNATHVADLVASGNESGKITLDERTRHSLMSSLHEKAEELETPFDTLTRLVDAGRQVALVKLGSDLGIFKSLAESTTPLSSGQLAEYKEADPLLVSRIVRYLVANRFVGEVAPDRYVSRKATHALADERIASSLRFFHAVSNPSFQALPDYLRETGYRNRTAGSALQKGLAAEQGMFPWLKQHPDVLADFQNLMGIPKESNGWDVIPLDMSLSANHQGPVLVDIGGSTGQQAKLLVAQHPELAGKVVVQDREETIKGAPAIQGVDLMAHDFFKPQPVKGAKYYYLRAILHNWDEDQAVQILANIVPAMSNDSLVLIDEVVISEKGAHVWPAGLDLQMLTLFGASERTGPQWDTLLDRAGLKPVSVRKYAPVMESCVIFASRK

SEQ ID NO: 33 - protein, 584 aa, Pseudogymnoascus sp.
MSVPQKCTVLVVGGGPSGSFAASTLAREGVDVVVLESENFPRYHVGESLLPSMKHFLKFIDLYDQWNAHGFIKKNGAGFKLNHAHGAAYTDFLAAGGPHGHAWNVVRSEADELLFRHAGVSGAKIFEATKVNALQFEPYNGPTMPDVPNPGRPVSATWSSKDGSSGTIAFDYLVDASGRFGLVCNKYLKNRKFNQSLKNIANWGYWKGGGIYGVGTHKEGCPYFEALTDGSGWCWFIPLHDGTHSVGIVQNQEMATAKKREQGSPSTKEFYKTSLDLVPGIKELLSNGELTSEIKAASDWSYTASTYSLPYVRISGDAACFIDPFFSSGVHLGVLGGLSAAVTIMASIKGECDELAAATWHTKKVTESYTRFFLVVSSALKQIRSQTAPVIQDIDEDGFQRAFDLFRPIIQGTADADSGGKLTKADISQTMDFCVKAFTHVSEEQQGALMKKLKAHGLDERLDDEAAKKVIDELEKDLTEEEQQVLNVLRSRRMIHEDSFNLDSFTLDSIDGMAPNLVRGKLGLIKQETAKISKATLYSTTFLEDMTPGTRTHRAEQTINEHQYSGRDTYTNARSSVLASAANR

SEQ ID NO: 34 - protein, 571 aa, Daldinia sp.
MNVPQKCTILVIGGGPSGSYTAAALAREGLDVVVLEADTFPRYHVGESMLPSVRPFLKFIDGYDKWIARGFRIKNGGAFKLDHSRPDTYTDFVASGGPEGYAWNVIRSESDELLFNHASSCGAKTFDSTKVNDIQFDPANVAPNFDGQIPGRPVSATWTRKDGSSGIIRFEYLVDASGRHGILSTRYLKNRKFNQGLKNIANWGYWKGGGVYGTGTYKEGSPYFEALTDASGWCWFIPLHDGTHSVGIVQNQEIATAKKREAGCESTKEFYLQSLNLLPGTKELLSKGELISDIRSASDWSYSASSYAFPYARIVGDAGSFIDPFFSSGVHLALNGGLSAAVTISASIRGDCDEETAASWHSKKITDSYTRFLLVVLSATKQIRHQNRPVIHDFDEDSFERAFELFRPVIQGTVDADVIVKPTQEEISKTVEFCFRSLADIPPEHKDALIEKLKSLGVEGEADDESTLRAIEEIEKNLTLEESQILNILRGRRMLRNEDSISLVNFTLDSIDGLAPRLEQGNLGLVKAAPIKASKAQLYSASFLRGGRPDIRTQRGDKVSRELGNDSAVSN

SEQ ID NO: 35 - protein, 577 aa, Hypoxylon sp.
MSIPQNCTILVIGGGPAGSYVAAALAREGLDVVVLEAEQFPRYHIGESMLPSMRHFLKFIDGYDKWNDHGFRVKNGGAFKLDPGLPDTYTDFVASGGPEGYAWNAIRSEADQLLFEHANSCGAKTFDATKVTSIDFEPYVATDATSKFEGPNPGRPISATWKHNDGDSGTISFDYLVDASGRRGILSTQYLKNRKYNEGLKNIANWGYWKDGGVYGPGTYKEGSPYFEALNDASGWCWFIPLHDGTHSVGIVQNQDSATEKKKAGDCPPTKEFYLQSLELAPGIRELLSKGELVSDVKSASDWSYSASSYAFPYARIAGDAGSFIDPFFSSGVHLAFNGGLSAAVTIAAAIRGDCDENTAASWHTKRIAESYTRFLLIILSSTKQIRNQNKPIIHDFDEESFERAFDLFRPIIQGTVDADVKRELTQDEISKAVEFCFRSFADFSSEKKDALIEKLKGLGLEDNEDVEKSATAIEEMQKSLTPDESRILDILRGRRMIRAEDSINLVNFTLDSIDGLVPNLERGKLGLIQATPVKTNNASLYSVKYLRGGRPDIRTQRGDKTSKAPEETTDEGSIPK

SEQ ID NO: 36 - protein, 530 aa, Coprinopsis cinerea
MGRTSPSSLRTQVLVIGGGPAGAYAASVLAREGFQTTVLEATKFPRYHIGESMLPSVTSFFEFIGLDEKLRNHGFCSKPGAAVKFNQRKKEGYTDFLKNNSEGTWNVVRSEFDEMLLRHAGESGATVLEEHKVIEIKFEDVSGKSRPYSAVFTRPSGERSEIHFDYLIDASGRNGIMSTKYLRNRKMNSSLHNIACWGYWEGGYGKYMPGTRRENAPWFEALTDESGWAWYIPLHNGTVSVGVVMDQDVSSSKKAKAREASATGEHTLCDHYLQQLELVPGLKALLGTATLVSNHVKSASDYSYSAERYAGDRFRIIGDASAFIDPLFSSGVHLALLGGLTAASTVAASVRGHCSEEEAAEYHHVKIGAAYTRFFLVVMSAYRQIRSQNVDILSDVDEDNFDRAFDIIRPVIQGTADVGRTLSESELQKTLDFCKDVWAPVDPEMHERVASRYGSELLSPAAPIFKPEDLDQIVDPNDEDAVDVFKRANARKIVDPMFKGISSLESEPVKGFITCLQRGSLGLIYIASAA

SEQ ID NO: 37 - protein, 550 aa, Sistotremastrum niveocremeum
MPVPTNPQNSIPSRTKVLVIGGGPGGSYAACALAREGIDVTVLEASRFPRYHIGESMLPSVRPFMQFIGCEQKIIDHGFTLKPGAAVKFNQWKQEGYTDFVALDPDNAAWNVIRSEFDNIIFEHAAESGANVFQQVKVTSIDFAPDSPPPSPPATLTGPRPVRAHYTRTHSGGATTTGTIEFDYLIDASGRNGMMSTKYLQNRKMNESLKNVACWGYWRGGAMYMPGTTRENAPWFEALTDESGWAWYIPLHNGTVSVGIVMDQSISNAKKAKSKAAAAPKEFTLTDHYHEQLQAFAPHLCKLLTKAHLVTDDGPAVKAASDYSYAATSYAGDHFRLVGDAAATLAFIDPFFSSGVHLAFTGGMSAAASVASSIRGQTTEAEAAGYHDAKVGVSYTRFLLVVMGAYKQIRAQSQPVLADVDENNFDRAFSIIRPVIQGTADAGKRLTENELQKTMDFCKHIFSPTDPEMHEAVGARVDPSLFSPEGPVMTPDDLDRVLDPNDDEARAVLQEVNARKPVHIMYNATGNFDMEDVNGWKVTVKRGNLGLRRA

SEQ ID NO: 38 - protein, 501 aa, Scytonema hofmanni
MSTLPKFTQVLVIGGGPAGSTTATLLAREGFDVTLMEKAVGPRYHIGESLLPSSMEILELTNAKEKVEAYGFQRKEGAYFEWGTDKWSFDFGQLNGKQKYSYHVRRADFDKLLLDHATSQGVKVFEGTEVRELSFNGARPQSAIWSQNSGDNSSGEISFDILVDASGRAGVMATRYLKNRQQNQVFQNIAVWGYWKGAGKVTEAPAGAFVGGSTEDGWLWGIPLHDGTLSVGVVMHKESYKARRSTSLEEFYLGAIAESPLMTKLLTQAELVSSVQAEQDYSYAAENFCGSGYFLIGDAACFLDPLLSTGVHLANLSALLASASITSLLRNEVSENQAISFYEKSYRQAYLRFLSLVSFFYDKKRGTDAYYEEAQELAHNDYRDSAPNTAFVNLVSGMEDLTEAQNGIDNLVIEKISQRAARSLSLEQVQEDLDGEKMDTQIMNVMEGMYTFSKDLSVEAAIDGFYVVTRPRLGLGRVSEKVEESAQKRLADSNAPSPSIR

SEQ ID NO: 39 - protein, 501 aa, Tolypothrix sp.
MSTLPKFTQVLVIGGGPAGSTTATLLAREGFDVTLMEKAVGPRYHIGESLLPSSMEILELTNAKEKVEAYGFQRKEGAYFEWGTDKWSFDFGQLNGKQKYSYHVRRADFDKLLLDHATSQGVKVFEGTEVRELSFNGARPQSAIWSQNSGDNSSGEISFDILVDASGRAGVMATRYLKNRQQNQVFQNIAVWGYWKGAGKLTEAPAGAFVGGSTEDGWLWGIPLHDGTLSVGVVMHKESYKARRSTSLEEFYLGAIAESPLMTKLLTQAELVSSVQAEQDYSYAAENFCGPGYFLIGDAACFLDPLLSTGVHLANLSALLASASITSLLRNEVSENQAISFYEKSYRQAYLRFLSLVSFFYDKKRGTEAYYEEAQELAHNDYRDSAPNTAFVNLVSGMEDLTEAQNGIDNLVIEKISQRAARSLSLEQVQEDLDGEKMDTQIMNVMEGMYTFSKDLSVEAAIDGFYVVTRPRLGLGRVSEKVEESAQKRLADSNAPSPSIR

SEQ ID NO: 40 - protein, 493 aa, Fischerella sp.
MSTLPKSTQVLVIGGGPAGSTAATLLAREGFDVTLVEKAVGPRYHIGESLLPSSMEVLELIGVKEKVDAYGFQRKDGAYLEWGSESWSFEFTKLNGKQKHSYQVRRADFDKLLLDHASSQGVKVFEGIEVRELSFNGTRPRNAIWSQTSGGNSSGELSFNFVIDASGRAGLMATRYLKNRRQNNVFQNVAVWGYWKGASKLTKGPEGAIGVGSIPEGWLWAIPLHDGTLSVGVVLHREAYKAQRSASLKEFYLNAIAECPLVAELLTQAELVSSVEAEQDFSYTSESLCGPGYFLVGDAACFLDPLLSTGVHLANFSGMLASASIASVLRNEVTEDQALSFYEKSYRQAYLRFLMLVSFLYDQKRGQKAYYQEAQELTHNDYKADAANAAFVNIVSGMEDLTEVQDGIDYQVTKKISQRVAKSISIDDFRKNYDPEVLDPQIMQAMEGTLSFSKDLSVEAAIDGFYIVTQPRLGLSRVQHKAEELLSSELFHS

SEQ ID NO: 41 - protein, 503 aa, Mastigocladopsis repens
MSTLPKSTQVLVVGGGPGGSTAATLLARQGFDVTLVEKEITPRYHIGESLLPSALEIFELLGIRDKVESYGCQQKEGAYFVWGPRQWGIEFQRLLNKYTFQVRRGRFDKLLLEHASEQGVKVFDGIEIRKLSFDGERPISATWSSGGMNGSSGEIAFDFLIDASGRSGLMSTQYLQNRRYHKEFQNIAIWGYWKNVDFSKIWPENGTVSARTEDGSGWIWAIPLSDDTLSTGLVLNKEIYKQRKSQASLEGIYAAGIADCPYVSDLVKTAELASPIKVEQDYSYVADKFAGPGYFMLGDAACFLDPLLSTGVHLAFFGGMLSAASIGSVLRNEVTQEQAYSFYDKTLRFHYLTLLVFVSSFYHITGNPEDMDMDADPSAGPRRFIAEVEDLQKVEPQMRQLVSEHMVELLTKAEEGVRLMVAEELEGTAKLSGELDPKHQAVFLQLWRGVFGYLPDFDGLRLKTQTNLRLVSVSEDDAAALTLDTVLDEKYYAQQEADMALTK

SEQ ID NO: 42 - protein, 462 aa, Moorea producens
MTLNNSDTFKMFDAIVIGGGPAGATCAYKIAANGHSVLLLEKAKFPRFHIGESMVPYLYKLFEMIDISDKIKEGGFVQKNGVEFLTGTTGDLRRQNFGNVAKGQTPFSYNLNRARFDKILLDHAQDTGAQVLQEADVKKLIFDGERLAGVEYQYQGCRHEARANFVVDASGRAGLIAKHFNLRKMNNKLQNVAVFQHYKDVVAENNPGVEGDVLFSCHEDGWLWGIPIETNVMSVGAVMPLSILKQSNPEEIFKAHCDRSPRIKSAIKGATPLFNKPKVELDFCYYSEQFTGPGYFIVGDAACFVDPVFSGGVFLSMLCGLKAAEAIHEIFDGKDDLEACQDFENLCKTGYDSYFRVVYSYYYEFNRDMNKMGLNLPGGFRFVLQTFAGDFWAERDQPVLSYLRSKKEWDTFEQPFERIYDCPIYPDTHYKAADPASFTPPEDFLESINTQTQTETQKAAVL

SEQ ID NO: 43 - protein, 462 aa, Calothrix sp.
MNIPQQCDVVIIGGGPAGSTAATILARKGYKVVLLEREKFPRERVGESMLPFCYELFRELGVLAQMEKRFVRKPGVRFINSDGSASTYWCFNHVIKDESYLSFQVNRSEFDTILLENSRKHGAEVREETRVDVCSLEVEGSTDKVEVQAISRNGERLSLQTRFVIDASGRSGFIASSKGWRKGHKGFARTALWTHWKGIKSLKGGLEEGSSIILYLGGEKRGWAWVFPLGIDWVTVGVVMDTAYLNHKRQELQASSIKDWCTELYQQELYSSEFIRELLAQARISMPVQVEGDYSYYSENKFSTKYAMVGDANRFLDPIFSSGVFLSMKSSFLVANAVDKMLLSNQANDMSYLEEAYAKINGAYDFVYRLISLFYQPHALSWAEAGATFNSVSQIDYKRHEVAMGAGHYMLAGDFFENHEKYHKFLDMMENPRFFEGYKNLVVDREEYQTESCGAERSIIFP

SEQ ID NO: 44 - protein, 466 aa, Fischerella thermalis
MNHSYYDVVVIGGGPAGSTLATLLVRKKYQVLVLEREKFPRFHVGESLLPATQLIWEKLGIAEPLQHLGNTFKYGTEIRMGLNPQQSEYEYSRQEFYKFPTQRLQQQPYAYQVERSEFDLFLLNHAREEGATVFEEAVVKEVLWEDDTATGIHWKSKDNIEYTTKAKFIADCSGRYGLITKSRKFLIPNKTIKTSAVFGHFKHVTRASGIQQGYFNGYVIENGWIWFIPLASDIMSVGVVMNEPGTSWWKQKSPEEILLTYIQQYKFIRERFEQAEQFSKVRMLRDLSYASKRSVGDGWILVGDANFFVDPLFSSGVHIAFRSAEKAADAIDEFLKNNRDRKSLQQYEKWSQKEHFHVSTTMALMYKMLKYRISMQLLIKLTGKYSNHWDNLLLRRLVAWGSGYYEEFHWTLYCSWLFCFLLIGIGKVCEKFLGISGWSTQPEFCSKSPLTFPKSVESLKNKHPEI

SEQ ID NO: 45 - protein, 468 aa, Nostocales cyanobacterium
MKDKKQYDVIIIGGGPAGTTCATMLSREGHEVLLLEKYKFPRFHIGESITAFGANAFKKLGIYGELKQIGYVKKKGAEFIFQEKSYSAYFNKSFQNESDELPWAFQMARSKLDLLLLENARKSGATILEQHVVKRVLFNGERAIGIEYKDLSKDAINPPLQYAYAKWIVDASGQAGMINKQVENNCYNDFLLNKKLAIFNHWEGDFEITNTDEDVNFKFCIHENRRDWAWYIPIDKNIVSIGVVLSEESIKNRTEGLEGVFYKYAEQLPFISDFLKNPTLKPIDKFRSARDYSYRCKQYYGDGWVLVGDSAGFIDPIFSTGLQIAFSSAFMLVDALHEVLSQKSPNYSKLKAYNRNVNKLYKINSMFVYLYYLSGLEFEKLWSISHMWKYLKWSGLKYPVLFFWYALQIRIASKKQARIWGDEVLFGIIKSQNPLANLLLALSENYERLQNRRAKNVISRNQFLEMEV

SEQ ID NO: 46 - protein, 437 aa, Nostoc sp.
MNIPQQCDVVIIGGGPAGSTSATFLSQKGYDVVLLERHKHPRHHIGENTIPQFWKYTDLAQVSDKIAAEGFIQKAGGTTFWNGRIRQVDFKDFGYSRQALHVERDRFDLILLENAREKGVQIFEEVSVLSVDLQDGQQEQSLTYRLLKDKSLGKITCRFIVDASGQNAVIAKQMGIRTIDKDFRFMSLWGYFKNSKYIGLNGKAHSVENLRTILPTTFICSFAETGNWGWSWHIPLRESTSVGLILPLEFMKTVQLNGGSWESYFRQKCCEIPILEDLLANAQFCEGSFAKIQDYSYRSTQLAGPGFFLIGDAAGFIDPIFSIGIVLGMYSAYTATWAIDRSFKNPSSLVHNQALFSSQLQGRLEVARSLALPHYQSGDRACDLAKTTIQMERALEQELMATWSTMTTRPENFQAIASSLKGREINSNKFRVIEEMI

SEQ ID NO: 47 - protein, 432 aa, Cyanothece sp.
MNYEIAIIGGGPAGASLATYLARAGKSVAIFEKSDFPRFHIGESLLPATMPILQDLGVYERMRSTFLNKPGGCWYYDDTPVMSDFAKCRETASFKDFRHAFMVERGEFDRILLDNARDHGVRVFQHHLVREAIWEGERMTGLQVKDLQTMEGKSIRTEMVFDCSGYRSVIASQRNLRKPNRLKKMAIFAHYRAEALEERLKQGWFVGQMFYDGWLWLIPIDKDRISIGVVTTLDNYKKASISPEQFLDHYIRTLSLTRKGLGKNIERVSDIYLYGNLGYSSERIFGDRWALVGDAAVFIDPCYSSGVHLAMDSAREIARVYLEHGYDARSLQNALSKYEKRLRQHEELVLMLVDSFYMASRNKFLRFLVKNLSKISSLNQKFVHFTGGDLADDPGYIKMTYYTHLAISALANVFQRQPSAAPEKGKSAVLIK

SEQ ID NO: 48 - protein, 340 aa, Planktothrix agardhii
MNIPQRCDVVIIGGGPAGSMAATFLSQKGYDVVLLERCKYPRHHIGENIIPQFWKYTDLAQVSDKIAAEGFIQKAGGTSFWNGLIRQIDFKDFGYSRQALHVERDRFDLILLENAQNKGVQVFEEVSVLSVDLQDGQQEPSLTYRLLKDKSSSKIACRFIVDASGQNAVIAKQLGIRTIDADFRFMSLWGYFKNSKYIGLDGKAHSVENLRTILPTTFICSFAETGNWGWSWHIPLRESTSVGLVLPLEFMKKVQLNGGSWESYFRQKCYEIPILEDLLANAQFCEGSFAKIQDYSYRSTQLAGPGFFLIGDAAGFIDPIFSLGIVLGIELLQNNFMVLW

SEQ ID NO: 49 - protein, 517 aa, Trichoderma gamsii
MAIPEKCTVLVVGGGPAGSYAASALAREGIDTVILEADKFPRYHIGESMLASMRHFLRFIDVDSEFDNYGFTKKVGAAFKLNPRKREGYTDFLAAGGPENYAWNVVRSEADHLLFKHAAKSGAKAFDGVQIKKINFVDAPYKGSGELPHEYPGRPVSASYLRKDDNTTHEIKFDYIVDASGRVGLLSTKHLKNRRYNQGLKNVANWGYWKGAGAYGKGTPRENSPFFEALQDESGWAWLIPLHNGTVSVGVVMNQKMSAERKSQMGSPDSKTFYLNCLKELAPDLSNLMENGELITDIKSASDYSYSASGYAIPYARIAGDAGCFIDPYFSSGVHLAFVGGLSAATTIAASIRGDCSEEDAADWHSKKVADSYVRFLLVVLSAYRQIRAQNEPVLSDFDEDNFDRAFAFFRPVIQGTADVDSKLSQAELSKTLEFCSNAFEPVKPEDRSSMLEKLGQNPDTAYQVDLSPQQRTVVDHIRARQMMRTEDTMNINSFGTDAINGFIPNLKKGGLGLVRA

SEQ ID NO: 50 - protein, 528 aa, Halobellus rufus
MAGSTISMILAKNDLDVLLIEAKKHPRFAIGEAMLPLSAVWMWIVGEYFDVPEIQHLSDANRIVDNVTESCGVKHSVGFAYHERGQPFSGEHAHQLVPPEMPFYKESHLLREHVDHYLVESAGSYGVEYVDETPITDVEIDDDEVTVTTDRGTTTGAVFVDATGGNSILAEKRGYRDETPDLETDTRAIFAHVEGLEPFDELIDEEDRPGQTNRLHDGTLHHVFEGGWLWVIPFDNFDRSTETKASVGLMLDRNTRPRDESLSAEEEFHEIISAYPDVERHLGPVEPVMPWIRTGRLQRSASESSGHRHLLTNHTYGFVDPLYSQGMVHTFESVFQSAKLLLEAFEVGDFSAERFAPIDDLHRRQLETADLLVSNAYTSMDEFDLWNAWTQLILVESVFPDLYIQRHCLKYLSSGDPAELDRLLRETRPGDDAPFAPEKDALLDRSSAVLDAYTAGEISAGTAAESLFDAMKRADWLPRSVYDWGNEDERHIDFADPAVTGELLAWGRTDAPAHIREGLFDFEMPEMP

SEQ ID NO: 51 - protein, 491 aa, Diploscapter pachys
MTPPPSSIAILGGGTAGWMAACLMAKAWPQARITVIESPDIGIVGVGEGSTPQLKALFDALGLAEADWMPAADATYKAGIAFHGWSDDTPAYFHPFAGQIDLHTQGAFFASTRARRHGADVPAHPDRFFLNARLAEAGRAPIAPAHFPFRIGYGYHFDAHKVGHVLRDAAVARGVVHLPRRVHDVVVDTAGQVVALTLDEGDALHAELFVDASGFASAIAQQALGVPFRSFANTLFADRAVVMPTPRQAALPVQTKATALSAGWAWGIPLTSRTGNGYVYASRYLSSDAAETELRRHLGLLDADVAARHLSMKVGRVETSWTANCLAIGLAQGFIEPLEATALHIVQATIEGFIGAYQAGSRDAFNAAIARRYDGIRDYIVAHYRLNRRSGPFWRDVAANDDLSDDLKAIMTAWFTGGDVAAVVEGRGLAGYYAPMSWEVLLAGYGTFPDATRLRTAPPVADLAAIDTLLSGCLLNFPDHQAALDGHRRMP

SEQ ID NO: 52 - protein, 364 aa, Ricinus communis
FAPRDHNAAPGSPLADIAYAYHFDATLYARYLRELAERRGVQRIEGKIVGVQQRADDGHIASVTLESGQVVDGELFIDCSGFRGLLIEQTLKTGYVEWSHWLPCDSALAVPSASVDPVTPYTRASAQRAGWQWRIPLQHRTGNGYVYSSKYISDDEAAATLLANLDSEALAEPRQLRFTTGMRRKFWHKNVVALGLASGFLEPLESTSIYLAQSGITRLLSMFPQRDVHPLLVERYNQESAFEYERVRDFLILHYHATERNDTPFWDYCRTMAIPDSLREAIDLFRSDGRYFRNGDDFFALPSWVQVMLGQGIVPRGYHPIVDEMPESVLIEQVGGMERMLADAVAAMPTHQEWINRYWKAPAL

SEQ ID NO: 53 - protein, 535 aa, Fomitiporia mediterranea
MPSEIPGTCTVLVIGGGPAGAFAAAALAREGIDVILLEADNFPRYHIGESMLPAMRHMFRFIDVDSAFDSFGFIIKNGAAFKLNQHNREGYTDFVAAGGPNNYSWNVLRSESDNILFRHAAASGAKVFDGVKVTELSFKPDDASHLGRPIRASYVFKSNRETGDIAFDYIVDATGRAGLMCTKYLKNRTYNQSLKNIAMWAYWKGTGVYGIGTPREGAPLAEALIDESGWAWFIPLHIGTSVGIVMDQELTNKKKRAHDPPLSGLEFYLEQLRLAPTIMSLLGSANPTNIDDEQMVRSASDYSYSSSCYSGPGFRIAGDAGAFIDPFFSSGVHLALIGGLTAALTICASIRGDCTESEAADWHSKKIGSSFTWFLMVVLGAYKQMKSQRDAVLTDINEDNFDRAFSFIRPIIQGSIDVDEQLSVSDLSKVIDICVRAFEPAQTESREAVLAKLKDECFATQVYENSQYLCIGNVGENVLSDDEKRVLAYINAREVLGARDRALTMNAFVTDVIGGRRPRLKQGELGLEIATNRMS

SEQ ID NO: 54 - protein, 559 aa, Dyella thiooxydans
MAQRPEFPAGLRPFFAIGQVSEDDGTAAGEEPAMARINKVLVVGGGTAGWLVACYLARAMRSSDPSGIQVHLVEAENIGLLGVGEATFPSIRGTLAAIGLDERHFLDGAHATYKQGIHYRHWVRPPGTPGRDAFFHPFNQPSQRPGGPELLPYWLLGEAPAELPFAEAVTLQSRVVEGGRAPKRPQDPDYQGPLNHAFHFDAACFARVLAEHGTQTLGVHRHVATVERAELDERGAIARLITTELGPMTADLYVDCTGLRSHLAGGTMQSPFLSRADVLFADRAMAMQVPYDRPDAPIPSYTIATAHEAGWTWDIGLQQRRGVGYVYSSRHTDDARAEQVLRGYLGNAAEGLTPLRIRFETGYRPEHWRHNCVAVGLAGGFVEPLESTGIALVELGAYLLTHALPADLDDLPRIARHYNTMMVARYERIIDFIKLHYCLSQRRDTPFWRDNTAPGSIPQTLQDKLALWRYRPPHRLDFVGDLEMFLVASWQYVLYGMEFRTDLTPMRRSYTQVAEARQEFATIQQVAARAQDDLPDHRAFVERMVREHRERAGRAHAAA

SEQ ID NO: 55 - protein, 502 aa, Sphingomonas parapaucimobilis
MTNDVVRVVIVGGGTAGWMAGAALTRLLSGQCSVRLIESEAIGVVGVGEATLPHIRSFNERLGIPEAEFMARTRATFKLGIEFRDWSRIGDSYIHPFGTFGRGTGAIDFHHYWSRLVREGRDLPPLDQLSYACTLAREARFEHPDQGRGGLSSTFGYAYQFDALLFAPYLRSLAEEAGAIRTEGLVVDVERDSQNGLIRAVVLDSGERVEGDLFIDCSGFRSLLLGQTLDEPFEDWSKWLPTDRAVAMPCRTETAVTPYTSAIAMPAGWRWRIPLQHRTGNGYVYASDFVSDADAAHALEKAVEGEKLAEPRLLRFKAGRRRRSWVGNCVAIGLASGFLEPLESTSIYLVQQAITALIELFPGRRMEASDRDEFNRVIDLEYDRIRDFLILHYHATSRDDSPFWNYVRTMPIPDSLGEKLELWRRRGRVVKYREGVFLDASWIAVYLGQGIVPEGWDPRADVAGTGDLVQAVAALRSEIAAEVAIRPDHRAFLERYCPMVAA

SEQ ID NO: 56 - protein, 1007 aa, Aspergillus arachidicola
MTNVPEKCQVLVIGGGPAGSYSASALAREGIDVVLLEAEKFPRYHIGESMLPSMRHFLKFIDAYDKWDAHGFNVKNGGAFRLNWSRPETYTDFISAGGPGGYAWNVIRSEADELLFKHAAECGVKTFDETKVASIEFAPSEDANPLGRPVSATWNRKDGTSGTVAMDYIVDASGRNGLISTKYLKNRTFNKGLRNVASWGYWKGGGVHGVGTHKEGAPYFEALKDASGWVWFIPLHNGTHSVGVVQNQEMATEKKRKMAEPSSKGFYLESLEFVPGIKELLSNAELISEVKSASDWSYSASSYAFPGVRIAGDAGSFIDPFFSSGVHLALSGGLSAATTIAAAIRGDCDETVAASWHDKKTSESYTRFLLVVSSALKQIRSQDEPVISDFDEQSFERAFDLFRPIIQGQADADAKGKLTQAEMSKTVEFCFRAFAHVSFEEKEALVKKLKSLGHDGDAYDEANRKALDELEKHLTPEEQAILKTLKGRRMVRPEDSLNIDNFTLDSIDGLAPRLEKGNLGLSPAKKAEVKFTTHDALSFLNGEARAAKKTLSDGQSQTNGNHMCKDHDQTNGHTETNGHIESNGNAATNGHTEANGQSHANGHTNGNHMTNGHDEVNGHNNVEVRTVKSCMADLIAAEKSSFQTPVEEATRHRLISSLHQSAEDLETPFDTVVRLVDAGRQTAMVCIGGDLGIFKSLVESKRPLSSEELAKATMADPLLVSRIMRYMVASRLVGETGPDQYVASKKTYVFADPRIEHPIRFFHAFSNPAFHALPEFLKETGYQNEPKGSAFQKALSTDLEPYPWLKQHPEVLKNFQAAMRLTRDANGVDMMPLDESVSSGHDGAMFVDIGGNTGHQAAEVLSKYPELAGRVVVQDRGEVIKCAPDIKGIQWMEHDFFQTQPVKGAKYYYLRAILHNWDDKNTVQILSNIVPAMSADSLVAIDEVVVPEENAHVWPAGLDLQMYSLFSTTERTASQWDTILDKAGLRAVAVKKYAPVMQSSVIFAAAK

SEQ ID NO: 57 - protein, 497 aa, Albimonas pacifica
MTAMSGGPDPLRVLVAGGGSAGWMAAATLDAALNRGGARAVAITVVESPDTPRIGVGEATIPTIRRTLRRLRIPEAEFLAAAEATFKQAIVFADWSGPGSGFAHPFHTRPGDGAEQAAARFLRSDGRTPFADLVTPQPALAAAFRGPRRAGDADYVGPLPYAYHMDAEAFAELLAARAVTRGVARVSAHLRPPERAPDRPLEAVEATDGRRFAADLFVDATGFRRLLIGQGGFLDQSRHLICDAAVALRAPCAPGPTRPFTVAAAREGGWTWDIPLRTRRGRGYVHATAHLAPEAAEDALRAETPGAGEARRLRFQVGRLAQPWQANVVAVGLAAGFVEPLESTGLHLADLAAGLLAENAPLAGPNPGLARAYNALLAAAHDEVVDFVNLHYAASPRRDTPFWRDAADPARRTDRVAHLLELWEARPPVAADFPSSLQAFNHRNWEFILHGLGWRPRALGPAGGPPLAPDPELAAEARRLAAELPGHDALLAALAPR

SEQ ID NO: 58 - protein, 503 aa, Cylindrospermum stagnale
MHVEKTIHNVVVLGGGSAGFLSALALKVKMPSLNVVVVHSKTIPVIGVGEATTAWIPWFLHTYLGLNRQQFYEETQPIWKLGIKFIWGNSHQSHFNYPFVTHLADKLSVLDKSTAYYCLDSTRESSIYSLLMEQYKSPCFRKENGDFVFDERFGYHIENASFVSYLERRAAELDIKIIDQPVVNIQVAENGYIHQLKLDDGTTLAGDLFVDCSGFRSTLLGEILQEPFCSFSSSLFNDSAVTGTWMRDDVIYPFTTAETMQAGWCWRIDLPEQVNRGYVYSSAFISDDDALAEMKRQNPLMGDDHHSVVRFKSGRHQRFWVNNVVGVGNASGFVEPLESTGLHMIGETIKCVCDVLIDSDQQPTPGLINLANQAIAEKWDDIRDFLSIHFKFNRRVTSDFWQHCWQQTDIGEAEAVVDFFQNNGPSPIGQLLLRKNSVFKYNGYLNLLMGQQVATKYQGNNEILDLDNWRQVKNYFLKNCDNALPIHEAIQVVKERKCQWLSS

SEQ ID NO: 59 - protein, 582 aa, Actinosynnema sp.
MDHKELAAGMGAGHRTELHAVLESLGESEAAAVRSWLGGGETPDPLALLGELAPVPSDLSRPDDADPQAIRRIGVIGGGTAGYLTALALKAKRPWLDVTLVESRQIPIIGVGEATVSYLTLFLHHYLDIDAEELYRCVQPTWKLGIRFDWGPHPDGFMGPFDWSADSVGLLGALAATGNINGSTLGSAMMVADRTAVFDVDGRPVSLMKYLPFAYHLDNGRFVSFLTDLARRRGVHHVEATLADVVVSGAEWVDHVRTDDGRELRFDMYVDCTGFRSRLLGQALGTPFTSFASSLFTDSAVTGNIDHGGHLRPYTQATTMNAGWCWRIPTRESDHRGYVYSSAAISDQEAADEFARRYPGVDGLRQVRFRSGRHEKSWRGNVMGIGNAYGFVEPLESTGLLMIAVAVHSLVSTLPGSWSEPSPRELVNAGLGQQWNAIRWLLAIHYRFNTRLDTPFWKEVRATADVSGFDTLLEVYAGGAPLSQRHVLVQDVLNRIAPTFFGLFGIDYLLLGQQVPTRRMPLAEPIERWHARKHAADALVAAALPHREALDAFDAHPELNKQLLEDTDSWAGRSIAKRVGLL

SEQ ID NO: 60 - protein, 1069 aa, Trichophyton violaceum
MVGLVAIISVWWCVRPKPNKIPIIGDAKNQNFMAALEEGSRKQYPESCFRIPTRDIPTIIVPRKCLSTIAYAPEHRLSLGREVYERLMGRYTKMVKSDHLAEFVRGGLSKQLGANISLLQEDAIWTISSQIGNCPEWKPLQLFPAMVKLVPLHIGRTFINSPLSREQEWIDLTLEYAISTVTIAAKMSNTHWMLRPFKALFLPEIGEMSQQFKQASKLLSPVLNARLLGDAPGTKDLMQWMIDNYPGQSNNLTLHTRLQLEAVQAATYNLAFQLIHFFFDILAHPEYIEPLRIEIQTVFDSCGRTWTPAALAELRKCDSFLKESQRLNPIGIVSVSRFALSKFDLPDGTTVPAGISVSAPAMTVNTDPSLWECPTQFDGYRFEKLRQIKGNEYKYQFSSISASELNWGYGTHSCPGRHFASNQVKVIIAELLMKYDFRFEENIQDNQTPKRPANNFDGVRIMPNPEARIMIRSREVGAICSVPEERDRGKGDRIYRASNHSRVNGTNKSFNFTEEANMSIPASCTALVVGGGPAGSYAASALVREGVDVVLLEADVFPRYHIGESMLPSIRHFLRFIDLDSKFDSYGFVQKNGAAFKLNSKPEAYTDFVAAGGPGSYAWNVIRSEADHLIFKHAGENGAKTFDGVKVNAINFEPLSEENSDPVSTDLGRPVSATWTRKADKSSGVIKFEYLVDATGRAGLVSTKYMKNRTYNQGLKNVATWGYWKGASSYGIGTPREGDPYFEAIADGSGWVWLIPLHDGTTSIGVVMNQAMATTKKREAGSSSQQFYLDNVKQIPGIWQLLDNAELVSDLKSASDWSYSASSYASPYLRIAGDAGCFIDPFFSSGVHLAFASGLSAALSIRAAQRGDCDEMAAAEWHSKKVAEGYTRFLLVVMSALKQISDRDEPVLTDWDEESFNRAFDLFRPIIQGTVDVDKTLTQAEIAQTINFCVNAFQNAGREEQDALMNKIKSVSETKNGEETDVVKKLKESLSADERRTLNTIQARQIIRSEDTMNIDNFTVDVIDGMVPNLKRGSLGLLRYVPKVKAGQQEDELRAKLGLPEKQESIFSY

SEQ ID NO: 61 - protein, 577 aa, Piloderma croceum
MSRSAVPKKAQILVLGGGPAGSYTACMLALEGFDVVLLEAAKFPRYHIGESMLPSCPQFLKLIDLEETVENFGFCNKPGAALKLVGEKKEAYTDFIRTHPENRSWNVTRADFDEILLRHAEKVGVKVFEETRAFSIKFVNDNPKGRPLAVKWQNIIDRNVSGTVSFEYLVDATGRDGIMAQKYLKHRKVNTSLRNVACWGYWKGAGVYGVGTSRENAPWFEAHTEESGWNWFIPLHNGMTSVGVVINEDAGNQRKLAAKRANGGVASTLKRHYLDCLQLSPGLIDLLGDAKLLEDGPYPVVQSASDFSYNAPTYSGDHYRLIGDAAAFIDPFFSSGVHLALTGGLAAAVSIASSIRGEYSETEGCKYHDAKIGVAYTRFLVVVLSAYKQMRAQNRSVLSDFDEDNFDRAFDIIRPVIQGDADVGRRMSEDELQKLIALCGSALLPVDPEVYARVVSRLDTKLVDPRGAIVTPEEIDLLVPNDLEARLVLKEINARKSTGGLFLTISDSFEEVTAGFSARVHRGNIGLISHAPKANSTSGFSIQVGKARPSHLPHLLLLFFGVVLALLFHQYGTFGVV

SEQ ID NO: 62 - protein, 716 aa, Cellulophaga sp.
MTIHFIEYEESKICQSIIKQLQEKYNFSCCLTKDLGCVKNNDLIIWFVQNENLESVLNTCANIRKHLPDTTILFVSAFECDKILIGPIYSPNNTSGLDSALFFLYQEKCEDINSKLKLKLPLFKDILGEEFYIKRIHKLTQKLAEKINEFKNVSQNKNSINKIEIYNIKESNFDERFVYPILEIKEDFYEKKKNSQLIQDINFINASKKDFRFKLLNKSTLNKTVAIVGGGTAGYLSAISLKTKHPELEVTLIESEKIPIIGVGEATTPDLVDFLFKDLKLDKLDFYKKVEPTWKLGIKFYWGESGDYTFNYPFGEHDLVSGYINGNIDHGSLTSILMSQDSSFILRKNEKDFYSLTNPRRIGYAFHLENRKFVTYLKNKAIELGVVRLQNTIDKVILNDSHNQVSSLITSDGKKLQCDYYLDCSGFKSLLIDKLDSQYFSYNDNLITDTAISFNVNHKGEIKPYTYAESMKNGWCWNIPLRDSDHRGYVYSSKLSSENDIIDELKLKYPNLTDYKVIRFKSGRHNSFIKGNVAAIGNSYGFVEPLESTGIHMITEHIKILTKSFDALINDRTGTLKGHLNRHIANKWDYLKWFLSIHYKYNKKFDSPFWEFCRNEIDVSKYQHILDLYKSDGPLQMLNNSLSDSLRFDFVDSLFGLKGVDNILLGQGVIPNSIDDIQNVGHELWKYNVNTWMNLSKRTIPLKEDIEILVQNPNLI

SEQ ID NO: 63 - protein, 545 aa, Hydnomerulius pinastri
MSATIPTHTQVLVIGGGPAGSYAASALASEGLQVVILEGAEFPRYHIGESLIPSVRHYLRYIGAEQKLADHGFKHKPGAAIKFNQFKREGYTDFVALGHSNNSWNVTRSDFDKMLLDHARESGAWVHEKTKVQSVRFSSSEPSRPVAAEWSQSSGTGQEGVISFDFLVDATGRTGLMSNKYLENRHYNESLRNIALWGYWKGVGTYGGGTTREGAPWFEALTDDSGWAWSIPLHDGTTSIGVVMNQKLYNERTKALPGSSTATRYQSFLSLAPHVFNLIGDGVLVAKPSVDGPPGSLDPLVRSASDFSYSAPEYGGNSFRIIGDAGAFIDPLFSSGVHLAMTSALSAAASICASVRGDCSEDVASAWHSRRFSLSYTRFQMVVLSAYKQIWATNLDVLNDVDEDDYDRAFASIRPVIQGASDMGTRLSEGELQNALEFCSKFFNPTSQERRGYYTLKHGLPKELFDITAPLVDPKNMDAALRSAGINLSEDGGSAQEDEVKLVMEQVNARRVLHREYAVNNLEAEEINGYAVRLERGSLGLVKVV

SEQ ID NO: 64 - protein, 552 aa, Trichophyton soudanense
MSIPASCTALVVGGGPAGSYAASALVREGVDVVLLEADVFPRYHIGESMLPSIRHFLRFIDLDSKFDSYGFVQKNGAAFKLNSKPEAYTDFIAAGGPGSYAWNVIRSEADHLIFKHAGENGAKTLDGVKVNAINFEPLSEENSDPVSTDLGRPVSATWTRKADKSSGVIKFEYLVDATGRAGLVSTKYMKNRTYNQGLKNVAIWGYWKGASSYGIGTPREGDPYFEAIADGSGWVWLIPLHDGTTSIGVVMNQAMATTKKREAGSSSQQFYLDNVKQIPGIWQLLDNAELVSDLKSASDWSYSASSYASPYLRIAGDAGCFIDPFFSSGVHLAFASGLSAALSIRAAQRGDCDEMAAAEWHSKKVAEGYTRFLLVVMSALKQISDRDEPVLTDWDEESFNRAFDLFRPIIQGTVDVDKTLTQAEIAQTINFCVNAFQNAGREEQDALMNKIKSVSETKNGEETDVVKKLKESLSADERRTLNTIQARQIIRSEDTMNIDNFTVDVIDGMVPNLKRGSLGLLRYVPKVKAGQQEDELRAKLGLPEKQESIFSY

SEQ ID NO: 65 - protein, 529 aa, Talaromyces cellulolyticus
MSIPTKTTVLVIGGGPGGSYTASALAREGIDTVLLEADVFPRYHVGESMVASIRHFLRFIDLDTTFNNHGFIKKTGAAFKLNNQKTAYTDFIVAAGPDSYAWNVIRSEADDLIFRHAGKSGAKIFDGVKVTSLEFVPNKEADLPTDGTADPGRPVSATWTAKDGRTGSISFDYLVDASGRVGIVTTKYLKTRSYNQDLKNVASWGYWRGAISYGVGTPKEGQPFFEALQDGSGWVWFIPLHDGTVSVGVVMNQEMSTQKKKESTTDNGRDFYIESIKDAHGVTHLLQNAKLDTEVKHASDWSYSASEYASPYVRVVGDAGCFIDPYFSSGVHLAFSGALSAAVSISASIRGHCDETQAWKWHSTGVRDRFTRFLLVVMSATKQIRARDAPIMNNQGEDGFDDAFTIIRPVIQGISDVTGKTTHDEVSRAVDFTTEAVAKTKPDDSANSSSQAGPQFTDTIQQGSLTKDEAKVLHMVKNVFKDFFVADVYNGYRAKLERGSLGLEKVNTEALLVGEKLSGTKTEVKEVEV

SEQ ID NO: 66 - protein, 556 aa, Moniliophthora roreri
MPTGCSNSSPPRSIDILVIGEKLTIPQLSPGGPAGSYAASVLAQEGLNVALCEASKFPRYHIGESLLPSVRNFLRFVGAEGKVAKHGFTRKPGGAIKFNHQKREAYTDFVAIGQENSSWNVVRSEFDELLLNHARSCGVSVFEQTKITSLTFAQEDPSRPVSASWISSESSGEHDGAPGERSGTICFKYLIDASGRAGIMSTKYLKNRHFNQSLKNIAVWGYWTGVSSYGLGTPRAGAPYFEALNDESGWAWFIPINNGTTSVGIVRNQQMHVEQLRCPVSGEIPFDGSAVPNPSQSRMVDQYAFNLSLAPGVVKLITEHGKLEEGSVKSATDFSYSASVYGGNGYRIVGDAGAFIDPFFSSGVHLALTSALSAATSICASIRGDCSEEEAAVWHTRRFSTSYTRFQIVVLSAYKQLRSQQLNILSDIDEDNFDRAFNFLRPVIQGNGDMGVRLHGRELEDCLDFCVKLFNPTDPEEHDRLRNDKNFDKALLDLSAPISNLSAITPGSAEAKEILEKVNSRKVLNAEYTTDSFVSESLGGYSVRFEKGALGLKKGA

SEQ ID NO: 67 - protein, 500 aa, Nostoc calcicola
MEKTIHNVVVFGGGSAGFLSALALKVKMPALNVVVVHSTTIPIIGVGEATTAWIPWFLHKYLELNREQFYEETQPIWKLGIKFIWGDSSQSHFNYPFVTHLADKLSVLSKSTAYYCLDSTTESSLYSLLMEQCKSPCFRRENGDFVVDERFGYHIENVSFVSYLERRATEIDIKIIDRPVVNIEVAENGYIRQLKFDDGTMLAGDLFVDCSGFRSALLGEILQEPFCSFASSLFCDSAVTGTWMRDDAINPFTTAQTMQSGWCWQIDLPDKVNRGYVYSSAFINDDDALQEMKRHNPLMSDRHSIVRFKSGRHQRFWVNNVVAVGNASGFVEPLESTGLHMIGETIKCVCDVLIDSDQQPTPALINLANRAIAQKWDDIRDFLSIHFKFNHRVESEFWQHCWHQTDIGDAEAIVDFFQSNGPSSLGQILLRPNSVFGYNGYLNLLMGQQVATKYQSHNDILDLDRWRQIQNYFTKQCANALSIHEAIQVVKERKCQWLTS

SEQ ID NO: 68 - protein, 514 aa, Massilia sp.
MSYQSIAIVGGGTAGWLAACYLQRALNGNPAHPVRITLIESPDVAAIGVGEATVPTLRMMLRTIGIPEAALFASAEATLKNGIRFVGWHDGTDSFDHPFDMPIVADGYSTMTHWLNLKQRGLTRQPFGEAGVVQPALMDALRSPKLMSSAPYEAPVPYAYHLDAVLLARLLRDTAKERGVVHVEGTVEQVDVDETGIRAVCLADGTRHAADLFVDCTGFASLLLGKTLDVPFHSYADTLLCDRALACPVAHEASDAPLRSHTVATAQDAGWTWDIELQTRKGTGYVYSSRHCSDDEALATLRRYNAGRTELAEPRLLRMRVGRHTRMWEKNCLALGLAGGFIEPLESTGIYLIEYALQMWLDYLPTPAGAAPMRDRYNMLMAEHYDELHDFVLAHYVLSARRDTAFWRACTEEVKVSDRLAALLALWKHKLPGTADIDARRQVLFGPHNWFFILAGQRCLPEHGIGQMPYIAPERSQAALARIAEIRKAAVSQSPSMREYAQKIRAAAANAPRR

SEQ ID NO: 69 - protein, 500 aa, Candidatus Thiomargarita nelsonii
MNSINNIVIVGGGTAGWTTAACLARVLKNTDTKITLIDSPEVATIGVGEATIPPLVEFIRFLGINEQEFVTKTQATFKLAIKFTDWNNLGEHYWHQFGSVGADIDGKPFYQHWFKSTLNGNENAYTDYSPAIAMAKENKFVVPPTQQQQQSILNGASYAWHFDALLVANFLTEFSTNLGVKHLKGHVECIEKHENGFIKNLILKDGRNINGDFFIDCTGQKALLIEGAMGSEFENWQKYLPMNRTIALQTENHGPLVPYTESTAHKWGWQWRIPLQHRTGNGMVFCDKYCSDDEALATLTNNISGKHLTEPKFISFTTGKRKELWKGNCLALGLSTGFMEPLESTAIHLMMKGVIKFAEMLPDQRCQQATINEYNRIMDIEFLSIRDFIILHYCTTSRTDSKFWQDCQNMPIPASLVEKLALFKSQGRLFRSEFDLFTPPSWYAILAGMNIKPDNYDRLIDISDINQVNSIMTNGLTSLNNTIIQLPSHEAFVKQFCKNI

SEQ ID NO: 70 - protein, 578 aa, Penicillium nalgiovense
MAAIQTVPEQCTVLVVGGGPAGSYASSALAREGISVVLLEADNFPRYHIGESMLPSMRHFLKFIDCYEKFDAHGFRVKNGGAFRLNWSRPESYTDFIAAGGPGGYSWNVIRSEADEILFRHAGESGASIFDGTKVTGIEFEESSEDVVDSANPNPGKPVSATWSRKDGSTGLVKFDYLIDASGRAGLVSTKYLKNRRYNQGLKNVASWAYWTGGGTYGVGTHKVGAPVIRTDASGWVWFIPLHNGTHSVGIVMNQAKATERKKAMDSPSSKEFYLENLNLVPGIQALLEKGELVSEVKSASDWSYSASSYAFPHVRIAGDAGCFIDPFFSSGVHLALSSGLTAAVTISAAIRGDVTEKEAAQWHSSKVAEGYTRFLLVVLSSLKQIRGGDEPVLNDWDEESFDRAFDHFRPIIQGTADADSEKKLSTEEISKTIDFCFRAFAHVPVERKDALLEKMKNHGVSDPTATDPKTREALEELKNTLSPEELDIMNTIRGRRMIRAEDSLNIDNYRLDSINGMAPNLERGNLTLRKAEINKIDVSKKDLLSLLSGEAAEGKHHETEETKAPAAAVAEVAEFAT

SEQ ID NO: 71 - protein, 522 aa, Sphaerobolus stellatus
MSNGVPSVPEKTTVLVIGGGPAGSYSSTLLAREGIDVVLLEASKHPREHVGESMLPSMRHYLRFVDLEEEYDRRKFMHKPGAAFKFVHGQRECYTDFSILGPDRTTWNVFRAEADEIMIRHAEKRGVKVFEQTRVESISFENDGDPATARPIAAAWKNKSGETGTIKFDWLIDASGRQGIMSTKYLKNRIYREGLRNVAAYGYWQNVSVFDEGGPRSNAPWFECLTDRYGWAWCIPLHNGKTSIGVVMHQETSNKKKAEGPSGLEAHYMEQLKLAPGIQELIGEKGTFVPGTVRSTADYSYHATSYSGDHYRLIGDAAAFVDPLFSSGVHIAMTGALSAAGTILGSLKGAVSELEAQNWHDAKIGICQTRFLMVVLSAYRQMQHQGNKAILGDVNADNFEHAFEIFRPIYQGEQDTSTKLTDDELEKMIEFTRNLFTPTTHQQYASVKQRHGDMLDLSAPVVSPGELDKVLDTEDSDAKAVLKRINSLKILRNETSPLSFTSEAVNGYILRLERGNLGLVKA

SEQ ID NO: 72 - protein, 539 aa, Panaeolus cyanescens
MSTEGPIPTKTNILVIGGGPAGSSAATILRREGHEVTLLEMAKFPRYHVGESMLPSLRNYLKFLGVEEDFVKHGFLDKPGACFKLVPNLRESWTDFTALGPGYATWNVVRSEMDEILLRHSAKEGVKVFEETKVDSIQFEGDPKTSRPISANWSKKDGTSGNITFDWLIDASGRNGIMSTKYLENRQMRENLRNVAVWGYWKDVNRYGVGTKKANSAWFEALRDETGWSWIIPLHNGTTSVGFVMHITNSNKKKARLNPDGTKMSLTDHYLDQLQYAPGVRELIGEKGSFIPGSTKSTSDFSYSATRYSGDHFRLIGDAANFVDPFFSSGVHIGMTGALSAAATICASIKGEADETTAQAWHDAKVGIAHTRFLFVVLGAYRQMHLQSTPLLGEVHEESFDKAFEMFRPVIFGLADSQKKLTDAKVNDVMDICQSFFDPTVDEDHIHATRQRYGVDLVKMQAPVLGKDKIQELVKDDEVGERVLKKFDALKVFSDDVEATYMGRNPLLGYRANVKRGELGLIKADEEDPLEKDILVAAP

SEQ ID NO: 73 - protein, 543 aa, Asticcacaulis sp.
MFLTCRRRLLDGAGFFLRLDTAMTTPKSGHRDAFFVLNGIEMTTTGPLRKIVIVGGGTAGWMVANALSKVLGKSGPAITLIESEEIGTVGVGEATIPPILAFNALLGINEVEFMKETQATFKLGIEFVDWLRIGHRYFHPFGIYGVDAGAVPFEALWQRSRHLGTPRPLNDFSVCARAAAMGRFMRPAGAGGPLAHLAYAYHFDATLYARFLRKYAEAAGVTRIEGRIAHTSQRPDDGFIEAVTTQDGRRIEADFFIDCSGFHALLIGGVMGAKFEDWNHWLPNDRAVAAPSANMAPPTPFTTSTSRTAGWQWRIPLQHRTGNGYVYSSAHSSDQAAQDLLTTNIAGDLLAEPRVIKFRTGRQRAFWIKNCLALGLASGFMEPLESTSIHLVQAGIARLLEMLPNRSCDPADIRRYNRLMTTEYDSIRDFIILHFHATERRDTQYWRSLANMSIPDTLAERIDIYRHSGRVFRESDDLFSKTSWLAVMDGQGLVPQAYDPLAEGVSPEQAQKHMEHIASVQAAAVKTMPSHHNYIAKYCSTAQ

SEQ ID NO: 74 - protein, 548 aa, Stachybotrys chlorohalonata
MSIPDSCAVLVVGGGPGGSYAASALAREGVNVVVLEADHFPRYHIGESMLASIRHFLRFIDLEKTFDSYGFCKKVGAAFKLNNKREGYTDFIAANGPNGYSWNVIRSEADKLMFEHAEKSGAFTFQGVKVESLQFVPDDGVAKDDTVCNPGRAISASWLRKEDGVTGNIKFDYIIDASGRNGIISTQYLKNRKFNQALKNVANWGYWKGATTYSPGTPREGSPVFEALTDQSGWCWAIPLHDNTLSVGVVMRQDLSLARKKSLGSPSMVEFYKDCITLSPDIHARLADAELVSNIKAASDWSYSASTYAGSNFRLVGDAGCFIDPYFSSGVHLALASALSAALTIQAARRGDCNELDAAKWHSAKVAESYSRFLLVVMTALKQIRKGDEPVLSDFDEDGFDRAFGFFKPIIQGLADADVGGKLTQGLISKSVDFCFHAFQDITPNVRQAVLDKLDSMKSDPSVETKEDLEKLSEDELTILRTIRARQMLRTEDTMNITSFANDVIEGYAPRLVCGSLGLSGMESRMAAPSNAETLFDSGIEILDENKS

SEQ ID NO: 75 - protein, 560 aa, Verruconis gallopava
MTTIPEKATVLVIGGGPGGSYAATALAREGVDVVLLEADKFPRYHIGESMLASMRHFLRFIDLDSTFDNHGFIKKRGAAFKLNDKPEGFTDFIAAGGPGNYAWNVIRSEADYLMFQHAGKSGVKTFDQVAVRSLEFTPCDLELPDPKTPSPGRAVAACWSSKVDGTSGKISFDYLVDASGRFGITSTKYLKNRKFNQGLKNIANWSYWKNAGRYAVGTQREGQPFFEALSDASGWCWLIPLHDGTASVGIVQNQDAAAAKKKAMDSPSQHDFYIESLKLAPRIQALLAQGEMTAPVKQASDWSYSASCYASPNVRIVGDAGCFIDPYFSSGVHLALSGAMSAACTIRAVQREECDEKAAMDWHSKKVAEGYTRFLLVVLSAMRQIRKSDQPILSDWDEEGFDRAFAFFRPIIQGTADVSNKLSQEELAKTIDFCLNAFQHHDADARDAMIKKLQEHEQEARMRGDVQAKADIDPDSLTPEELQVLKTIRARQMLRTEDVINIDSFGTDAIDGFAPRVKHGELGLMKGKNSGPAAPKMDLFAKAKEEPAMQTQVGTAVTAH

SEQ ID NO: 76 - protein, 552 aa, Trichophyton rubrum
MSIPASCTALVVGGGPAGSYAASALVREGVDVVLLEADVFPRYHIGESMLPSIRHFLRFIDLDSKFDSYGFVQKNGAAFKLNSKPEAYTDFVAAGGPGSYAWNVIRSEADHLIFKHAGENGAKTFDGVKVNAINFEPLSEENSDPVSTDLGRPVSATWTRKADKSSGVIKFEYLVDATGRAGLVSTKYMKNRTYNQGLKNVATWGYWKGASSYGIGTPREGDPYFEAIADGSGWVWLIPLHDGTTSIGVVMNQAMATTKKREAGSSSQQFYLDNVKQIPGIWQLLDNAELVSDLKSASDWSYSASSYASPYLRIAGDAGCFIDPFFSSGVHLAFASGLSAALSIRAAQRGDCDEMAAAEWHSKKVAEGYTRFLLVVMSALKQISDRDEPVLTDWDEESFNRAFDLFRPIIQGTVDVDKTLTQAEIAQTINFCVNAFQNAGREEQDALMNKIKSVSETKNGEETDVVKKLKESLSADERRTLNTIQARQIIRSEDTMNIDNFTVDVIDGMVPNLKRGSLGLLRYVPKVKAGQQEDELRAKLGLPEKQESIFSY

SEQ ID NO: 77 - protein, 554 aa, Penicillium nalgiovense
MSIPEQTSVLVVGGGPAGSYAAAVLAREGIDTVLLEADLFPRYHIGESMLPSMRHFLRFIDLDETFDKYGFVQKVEFHLHKAIKKGAAFKLNSFPEAYTDFVAAGGPDAYAWNVDRAEADNLMFQHAGKSGAKVFDGVKVTSIEFTPLDEQNGQTDSELPSPGRPVSASWARKDGTSGTTQFEYIIDASGRAGLVSTKYYKNRTYNQGLKNIASWGYWENAKIHAPGTQREGQPFFEALQDASGWVWTIPLHNNKTSVGVVMNQATATTKKKAMEDSSTKGFYIDTLKSTPETYDLIADAELVSDIKSASDWSYSASTYATPYIRIAGDAGCFIDPYFSSGVHLALASGLSAATTICAAKKGQITESAAADWHSNKVGTGYTRFLVVVMSALKQITKPEEPVIGDWDEKSFDRAFSMFKPIIQGSADVKSNLTSEEISQTIDFCMKAFHPAPKEQREAIFDKLASGSASASGSANPTLSEQTLSADEQRILTTMRARNAIRTEDLIHIDNFSVDVVDGMIPRLKRGELGLIDAATAHIKAPNADTKQSVSIFSY

SEQ ID NO: 78 - protein, 548 aa, Stachybotrys chartarum
MSIPDSCAVLVVGGGPGGSYAASALAREGVNVVVLEADHFPRYHIGESMLASIRHFLRFIDLEKTFDSYGFCKKVGAAFKLNNKREGYTDFIAANGPNGYSWNVIRSEADKLMLEHAEKSGAFTFQGVKVESLQFVPDDSLAEDDTVCNPGRAISASWSRKEDGATGTIKFDYIVDASGRNGIISTQYLKNRKFNQALKNVANWGYWKGAKTYSPGTPREGSPVFEALTDQSGWCWAIPLHDNTLSVGVVMRQDLSLARKKSLGSPSMVEFYKDCITLSPDIHARLADAELVSNIKAASDWSYSASTYAGPNFRLVGDAGCFIDPYFSSGVHLALASGLSAALTIQAARRGDCNELDAAKWHSAKVAESYSRFLLVVMTALKQIRKGDEPVLSDFDEDGFDRAFGFFKPIIQGLADADVGGKLTQGLISKSVDFCFHAFQEITPDVRQAVLDKLDSVKSDPGVETKQDLEKLSEDELAILRTIRARQMLRTEDTMNITSFASDVIEGYAPRLVCGSLGLSGMESRTAAPSNAETLFDSGIEMLDENKS

SEQ ID NO: 79 - protein, 545 aa, Bipolaris oryzae
MSIPEKTDVLVIGGGPAGSYAASVLAREGVDVVLLESDKFPRYHVGESMLASMRFFLRFIDLEKTFDAHGFQKKFGATFKITEKKAAYTDFAAALGPGGFSWNVVRSESDELIFKHAGESGAKTFDGTKVESLTFESYSDGEFSAENHLANPGRPTTATWSRKTGETGTIQFGHVIDASGRNGIISTKYLKNRRFNQGLKNIANWTYWKGATKYNAGSETENSPFFEALSDGSGWVWAIPLHNDTLSCGIVVYQELFFAKKKASGLDGLSFYKEYLKLAPQINSMVANAEIVSEMKQASDWSYSASAYAGPGFRIVGDAGCFVDPYFSSGVHLALTSGLSAAVTIQAVRRGQAGEEQAAKWHATKVSEGYTRFLLLVMTVLRQLRMKEAALITSEQEEGFDMAFKTIQPVIQGIADTNTEDADVQKRTAKSINFGLESMNVSSAAEDAVVKKIREAENRPEMLEKLTTEEVSILDRITKRTFAHEKDELNLTHFTGEVIDGFSARLVRGDLGFVNHAAQPATADQPVVSAAVDMSGLDRNIKQAA

SEQ ID NO: 80 - protein, 545 aa, Bipolaris sorokiniana
MSIPEKTDVLVIGGGPAGSYAASVLAREGVDVVLLESDKFPRYHVGESMLASMRFFLRFIDLEKTFDAHGFQKKFGATFKITEKKAAYTDFAAALGPGGFSWNVVRSESDELIFKHAGESGAKTFDGTKVESLTFEPYSEGKFSTENHLANPGRPTTATWSRKTGETGTIQFGHVIDASGRNGIMSTKYLKNRRFNQGLKNIANWTYWKGATKYNAGSETENSPFFEALSDGSGWVWAIPLHNDTLSCGIVVYQELFFAKKKASGLDGLSFYKEYLKLAPQINSMVANAEIVSEMKQASDWSYSASAYAGPGFRIVGDAGCFVDPYFSSGVHLALTSGLSAAVTIQAVRRGQSGEEQAAKWHATKVSEGYTRFLLLVMTVLRQLRMKEASLITSEQEEGFDMAFKTIQPVIQGIADTNTEDADVQKRTAKSINFGLESMNVSSAAEDAVVKKIREAENRPEMLEKLTTEEVSILDRITKRTFAHEKDELNLTHFTGEVIDGFSARLVRGDLGFVNHATQSASADQPAVSAAVDMSGLDRNIKQAA

SEQ ID NO: 81 - protein, 542 aa, Arthrobotrys oligospora
MAIPQSCTVLIVGGGPAGSYAAAVLAREGIDTVVLEADKFPRYHVGESTIPSLHYLFKFIDFHETFSSYGFNQKNGAYIKLAKNQPVTSNDFRALQGPNGFAWNLIRSEFDDLVFRYAGTCGARIFEETKVENIEFEPCSIQTVPGSKEDSSGLFHARKPVSANWVRKIDGTSGSITFKYLIDASGRQGVLSTKYLKNRKFNENLKNVASWAYWKSDNVYAAGTPTEGAPYFEALEDCSGWAWYIPLHNGTRSVGIVQDQKLMAKKKASLGRPSTLEFYNECIKMAPTIKDLLKGAEFINNIQSASDWSYTASTYHIPNARICGDAGAFIDPLFSSGVHLAMNGGLSAAATICASIRGHCDEATAGSWHSKRTVESYTRFFLVVSSVTRQMRQQNEPILRDNDEEGFERGFQIFRPIILGAVDNNIGNKHSKVGIAKALEFCFEAFTRVTSETKDSTPQDPKTLGFSSGNNTITSHRNLEGLRQNLTPNQIEILETLTSRRMIRDDRFEIDSHTFDTIDGYLLNAVRGKLGLVKAEQVKVNI

SEQ ID NO: 82 - protein, 908 aa, Aspergillus niger
MTVPQSCTVLVIGGGPAGSYAAAALAREGIDTVLLEADKFPRYHIGESTLPSLRHFFKFIDFYDTFDAHGFYHKNGAVFRLAQAQPDAYTDFLEAGGPDAYAWNLVRSESDDLLFRHAGTCGAHIFDETKVDTIQFEPHISESSKPDSDDNKILNPGRPVSATWVRKDGSSGFIALKYLVDASGRNGILSTKYLKNRKFNDNFKNFANWAYWKTDNLYGLGTHMEGSPYFEALDDASGWAWFMPLHDGTRSVGVVQDQKLVTEKKRELGRPSTLDFYKQCVEKAPRTSKLLSGAEIVTTVRTASDWSYTASTYHIPNARICGDAGSFIDPLFSSGVHLAVTGGLSAAATIAASIRGDCDEETAGSWHSKKTVESYTRFFLAVSSATKQIREQYEPIIQDMEEEGFQRAFDLLRPIIQGTVDADDTGKISHSEISKALEFCFRAFTYVPPEKKDALFEKLKNLGVGSGQKDAREAKILDGLEQHLTTDELQVLEILRSRRMIREDPFEMDSFTLDTIDGMAPNLGSFLFTAISGRLLAAVAVHAAPAEPAHPMVTEAPDANLIEKRATTCTFSGSEGASKASKSKTSCSTIYLSDVAVPSGTTLDLTDLNDGTHVIFQGETTFGYEEWTGPLVSVSGTDITVEGESGAVLNGDGSRWWDGEGGNGGKTKPKFFYAHDLTSSTIKSIYVENSPVQVFSIDGSTDLTMTDITVDNTDGDTDDLAANTDGFDIGESTYITITGAEIYNQDDCVAINSGENIYFSASVCSGGHGLSIGSVGGRDDNTVKNVTFYDVNVLKSQQAIRIKTIYGDTGSVSEVTYHEIAFSDATDYGIIIEQNYDDTSKTPTTGVPITDFVLENIIGTCEDDDCTEVYIACGDGSCSDWTWTGVSVTGGKVSDDCLNVPSGISCDL

SEQ ID NO: 83 - protein, 540 aa, Pestalotiopsis fici
MSVPAQTSVLIVGGGPAGSYAATVLAREGVDVVLLEAEKFPRYHIGESMLASIRFFLRFVELEEEFDRHGFEKKYGATFKITEKNPAYTDFAASLGEGGYSWNVVRSESDEIIFRYAGKCGAKTFDGTKVESLTFEPYPHEGFDESVHLANPGRPVSANWSRKDGSSGVIKFDYIIDGSGRNGLISTKYLKNRSFNQGLKNIANWTYWKGAKRFNVGEKNENSPLFEALKDGSGWVWAIPLHNDTISVGVVARQDAFFEKKKESGLSGEAFYKEYLKLAPQIKNELLRDATIVSDIKQATDWSYSASAYAGPNFRLIGDAGCFVDPYFSSGCHLAMTSALSASVSIQAVRRGQCDELTGAKWHTTKVAEGYTRFLLLVMTVQRQLRMKDKNIISTDEEEGFDMAFKKIQPVIQGVADTRTEDEQTQRRAAEAVDFSLESFEITPEKQAAVISKIERSQAEPELLEKLTPEEVHILGNIVNRTFEREKDELNLTHFTGDMIDGYSAKLEHGNIGLYKREKALLNGTASRAAAVLKSIHQVA

SEQ ID NO: 84 - protein, 521 aa, Nectria haematococca
MSVPSQTSVLIVGAGPAGSYAACVLAREGVDVVLVDADKFPRYHIGESMLAAIRFLLRLIDAEEAFDKHGFEKKFGATFKITDKREAFTDFSEALGPGGHSWNVIRSEADELLFKHAANNGAKTFDGTKVDSINFEPLPDFEMGEGSHLANPGRPVSADWSRKDGTRGNIKFDYLIDASGRNGIICTKYLKNRKFNEGLKNLAQWTYWKGAKRFNVSKRNENSPFFENLDDASGWVWAIPLHNGTLSVGIVARQDLFLAKKKELGLSGQEFYREYLKLAPQISEMLSNAEIVADVKQASDWSYSASAYAGPYFRVAGDAAAFVDPYFSSGVHLALNNGLAAAVSIQASRRGQADERAAAKWHATKVAENYTRLLLIVMAVQRQLRLKHEELITSNSEDGFDTAFKAIQPVIQGVADTHESDASVQNKAVESVNFALESFEVTPEQEKLMTEKVVQAAQRAPETLQKMTPEEVDILKRMSHRVLHRNTNRNNKGLVDFTGQVIDGFSAILERGDVGLIKVED

SEQ ID NO: 85 - protein, 535 aa, Hydnomerulius pinastri
MTQTIVPTQAQILVVGGGPAGSYAAAVLAREGFDVVVLEAAAFPRYHIGESLLPSVRHFLKLIDAECLVAAHGFTAKPGAAVKLNQHMREGYTDFIALNPNHGAWNVIRSEFDDLLLRHAAKCGATVIQRTRVSEIYFDEDNPDCPISASWKNESGIEGRIRFDYLVDASGRSGIMSTKYLRNRRFNKSLQNTACWGYWEGAEVYMPGTSRENAIWIEALNDESGWAWFIPLHDGSASVGLVMDQKISMSKKSAAREFSGASDYRLEDHYLSELKRAPGVLKLLSRAKLRSKGEKEAVKTAGDFSYSATSYAGDHYRLAGDAGAFIDPFFSSGIHLALTGGLSAALTISASIRKTASEDLAQRWHSSKVGTSYTRFLLVVLGTYQQIRSQTVPIMSDVDEDNFDRAFSLIRPVIQGTADVGRVVSEDELQKTMGFCRHIFAPTDPEMHSAVNTRLGSEILSPSGPVLTEAQINELVAQDDLEAKLVLCEVNARKPIHAMYSPTQHFQLEAHLGHAAVLERRKLGLRRVTPCDTEL

SEQ ID NO: 86 - protein, 516 aa, Gymnopus luxurians; identical to SEQ ID NO: 18

SEQ ID NO: 87 - protein, 506 aa, Botryobasidium botryosum
MNVPTHTEVLVIGGGPGGSYAAAALAREGIEAVVLEADLFPRYHIGESMIASVRHFLRIIGLDEKFDNYGFTRKVGAAFKLNDFKREGYTDFLARGPQNYAWNFIRSESDELMFRYAGECGAKIFDGIKVTDLISQTGDIVSTRPTSAHWKSKSGSFGIITFDYLIDASGRAGILSTKYLKTRTFNQELKNVATWGYWTGCSVYGAGTPRNNSPFFEALQAALLLALVAIDESGWAWMIPLHNGTTSVGIVMNQEISNKKKANHPSGRSPSMQEHYLEQLKFAPSILALVGPGELVKDATTGSVVKSASDYSYSASSYAGDHYRIVGDAGAFIDPFFSSGVHLALAGALSAALSICAARRGDCTEEEAAVWHSSRVSTSFSRFLVVVLAAYKQMRAQAQPILASADEPDFDRAFEQFRPVIQGSADVDHSTSARHASEAGSGCARPIEFCEQSDTTRPGGDSTAPKGPMWKTRTEDTFHIDHFATGVINGFCPRLERGSLGLTPVD

SEQ ID NO: 88 - protein, 523 aa, Sphaerobolus stellatus
MASNSDNAMLPAKVTVLVAGGGPSGSYAASILAREGINVMVLESQKFPRYHIGESTLASIRHFLRFIDLEKTFDEYNFAKKFGAAFKLNQTRDDNYTDFVASDPSNYAWNLVRSESDHLMLQHVVSCGGLVFEETRVTDVDFEPVLGSSETRPVSAKWRNKAGQTGTVSFDYLIDASGRQGLLSTKYLKNRVINADFRNVAVWGYWSGCAEYKPGTLRAGAPYFEALTDSSGWAWLIPLNLKYTNESGTASIGIVMNQEIADAKRKDNVNSKPLSAQEHYLQTLELAPTLKSMIEDAELLRPAGEPVIRSASDYSYSAQSYAGLNYRIVGDAGAFIDPYFSSGVHLALLNGLSAAATICASMKGECQESDAAQWHTTRVDTSYTRFLIIVKSIYREIRSQQTPASSENGFDKEFEEIAPVIQGHIDCRTELSASDMEKLVDFYSRHAYEPSTTEERTNILARVQDGSFNNSTLTKRENAILNSLKVRKLYRLEDINRINHFVEDNIHGRRLKLERGRLGLVEA

SEQ ID NO: 89 - protein, 609 aa, Piloderma croceum
MIFPPPHHPPKHVQVLVIGGGPAGSYAAAALAREGLDVAIFEATKFPRYHVGESLIPSIRHYMRFIGAEEKLANHGFVRKPGSAIKFNQFKREGYTDFVALGHNNNAWNVVRSEFDEILLKHARSSGAKVTELIRVKSLSFSSTDPSKPISACWTHSPSFCFSSSSSSSSSGTDDDLPNAPITGTTTFDYVIDATGRAGLISTNYLKNRHFNASLKNIAIWGYWKDVDTYGVGTEREGAPWFEALTDESGWAWFIPLHDGTTSIGIVMNQKIFNADAKTTDSSPSPSLTSRYRSYLPLAPGLLELIGDGVLTTKPVSPPNSPNGSDSTANDFRSKEPLVKSATDFSYSADQYAGHGYRIVGDAGSFIDPFFSSGVHLALTSALSAASTICAALRGDCSEQEAAEWHTKRVATSYTRFQVVVLSAYKQIRAQSTDVLSDINEDNYDRAFGFLRPVIQGASDMGTRLSENELQKSLDFCVNLFSPTSPEQHERVANSGVSKNLLDVNAPLMDSDTLEGALRKLAETKMVVNKINARRVVHSEYAINNLESEGLNGYVVRLEKGKLGLTRVLLRTLIPFNLLRILPNVRDEAVFDLISDTSSDLEKNFAKSS

SEQ ID NO: 90 - protein, 527 aa, Botryobasidium botryosum
MSAAVPQKTQVLVIGGGPGGSYAASALVREGHEVVLLESAKFPRYHIGESMLPSMRHFLRFIDLEDEFEAHGFAIKPGAAAKFTAHKKEGYTDFVEKGQTKGTWNVIRSEADEIMLRYAGRQGANIIEETKVTSINFAGDPAESRPISAEWKNVQGQTGTIEFEWLVDASGRDGIMSTKYLKNRRFNEAFKNVAFWGYYTGTGKYEPGTHRENAPFFEALNDESGWAWFIPLHNGTTSVGVVMNQEVYTQKRKSEKATRPSLQEHYEGQLAEWAPTIMRLIGEGKIKTNVEGPTVKMASDYSYNAPSYAGDHYRIAGDAGAFIDPFFSSGVHLAILGALAAATSICAEIRGQCKSADAEKWHTDKINVSYTRWLLVVMSAYKQMRASNEPVLADVDEESFDRAFDFFRPIIQGSSDYGKSLTRDELNKAIDFCGAIFHEFKPEDIDAAVERAGPAVLEGNAIPGAAPAAVDPEDEKAQEVLKLLSASKHVMTKEQDHGLHVFGADAVNGLKVILERGNLGLYRVDSE

SEQ ID NO: 91 - protein, 394 aa, Aspergillus carbonarius
MAIPQKATVLVIGGGPGGSYSASALAREGIDTVVLEADVFPRYHIGESLVASIRPFLKFIDLDDTFVNYGFVRKNGAAFKLNNQKEAYTDFILEAGADTFAWNVVRSESDDLMFKHAAKSGAQTFDGVRVTSIEFTDDDDDDDNNTNRPVSASWKAKDGRTGSIEFDYLVDASGRAGITSTKYLKNRTFNNYLKNVASWGYWEGATPYGMGTPVEGQPFFEALQDGSGWVWFIPLHNNTTSIGIVMNQELSTQKKKLSTTTSSRAFYLESLAGARGISRLLDPTTATLTSDIKHASDWSYNASAYGSPYLRIVGDAGAFIDPYFSSGVHLAVSGGLSAAVSIAASIRGDCPEEAAWKWHSQGVANRYGRFLLVVLGATKQIRAGDRPVLNGVGD

SEQ ID NO: 92 - protein, 552 aa, Rhizopogon vesiculosus
MSQQIPKNAQIVVVGGGPSGSYAASALAREGLDVVLLEAAHFPRYHIGESLIPSVRHYLRFIDAEQKLVDMGFKHKPGAAMKFNQFKREGYTDFVALGHSNSSWNVVRSAFDKMLLDHATSCGTKVFERTRVESFRFSATDNSRPVAAEWFCAADGKRGVISFDYLVDASGRSGLMSTKYLRNRHFNASLKNVAIWGYWVGVSKYGINTPREGAPWFESLTDESGWAWFIPLHDGTTSIGIVMNQAIYNEKVRTLKGSSLEDRYRFSISLAPGLVRLIGSGRIVQKEGVERQSGQFDLLIRSASDFSYSASSYGGPGFRLVGDAGAFIDPFFSSGIHLAMTSGLSAAVSICAAVRGDCSEIDAAAWHTKRFSLSYTRFQMVVMSAYKQIRSTDLEILTEVDEDNYDRAFAAIRPVIQGAGEMGSRLSEKELESALEFCSKCFNPASHEHLAFAAKQDLPKDILDVTGPIIDPQVIDSVISKTSEHMDSKGGQQLFGSVEDLKLLLDQINGRRVVHREYTINNFEVEDVNGFVVRLRKGYLGLMRTSTTSKVN

SEQ ID NO: 93 - protein, 587 aa, Hebeloma cylindrosporum
MPSALSVSSLPPKLTQVLIIGGGPAGSYAAAALAREGIQVTLLESSKFPRYHVGESLIPSARHYLRFIDAEKKMINCGFARKPGSAIKFNQYKREGYTDFVALGHNNNAWNVVRSEFDLMLLNHARTTGASVYEQTKVDSISFSSSDPDRPISVSWTHTPPPCPPSPPASPTDGVFPSLFSSKIVTPDQPPPPARGETAFAYLIDASGRAGILSTRYLKNRHFNASLKNIAVWGYWKNASQYGSGTAREGSPWFEALTDESGWAWFIPLHNGTTSVGIVMNENMYKAKYQQPPSSVFAAGSSSNSHVTIRYLSNISLAPGVVKLITPSGVLDEGSVKSASDFSYSAPSYAGNGYRIIGDAGAFIDPFFSSGVHLAMTSALSAAATICASIRGHCSETRSADWHTRRVSTSYTRFQVVVLSAYKQIRAQSHDILSDINEDNYDRAFSFLRPVIQGASDMGARLSETELQKSLDFCLNLFNPTTPEQHECLSHYGDVAKELLDVAGPVVDPSIFERSLHVSQASMGDTEDAANSSDCEKAVETRMILNKINARRVVHPEYAINNLETESLDGYVVKLERGKLGLTKAPF

SEQ ID NO: 94 - protein, 542 aa, Paxillus involutus
MSSAIPTHTQILVVGGGPAGSYAASALAREGLQVILFEAAQFPRYHIGESLIPSVRHYLRFIEAEQKLAEYGFKHKPGAAIKFNQFKREGYTDFVALGHSNSSWNVTRSAFDKMLLDHARESGACVHEKTRVNSLRFSSSDPSRPVAAEWSQSSETDHSGVISFDFLVDATGRGGLMSNKYLRNRHYNESLRNIALWGYWSGVGAYGGGTAREGAPWFEALIDDSGWAWFIPLHDGTTSIGIVMHQELHNEKSKALHGSSTVSRYQAFLSLAPNLTALIGRGVLVSKLSVDGPPGSLDPLVRSASDFSYSASAYGGNSFRIIGDAGAFIDPLFSSGVHLAMTSALSAAASICGSIRGDCSEAIAAAWYTRRFSLSYTRFQMVVLSAYKQIRATNFDVLNDVDEDNYDQAFASIRPVIQGASDMGTRLSEAELQGALDFCSKLFSPTSPEQRACALRYGLPTKVLDVSAPLLDPKDIDAALSRVEGISSDGNLNHDARLVMEHANARRVLHREYAVNNLEAEEIGGHVVRLERGSLGLMKLRG

SEQ ID NO: 95 - protein, 519 aa, Amanita thiersii
MDTVPSSTTVLVIGGGPGGSYTASVLSREGFDVTLLEAVKHPRYHVGEGMLPSMRHFLRFVDMEEEFHNHGFKHKPGATFKLHHSTPETFTDFSTLGPSRTTWNVIRSEADEMLLRNASRQGVKVFEETRVTSIDFEGDPATSRPIAADWTNKKGESGKIKFEWLVDASGRAGIMSTKYLKNRNFREGLRNIATWGYWRNVKIYAEGTKRSNAPWFEAMTDGLGWAWLIPLHDGTTSIGIAMHQNVSDMKKKNHPGGKPSLTEHYLDQIKFLPGVLELLGEQGELVPGSVKSSTDYSYSASRYSGDHFRIAGDAASFVDPFFASGVHIAMTGALSAATTICASAKGQVTESEAQHWHDAKVGICHTRFLIVVLSAYKQMQSQNRPVLSDVSEDNFDRAFSLFRPIIQGAADTTNKLTEEELEGMLDFCMHLFDPGEHAGVAQRLQPDLLALHGPVMGSAELDKALPPEDVEAKKFLSRFNALKILRNDTSPESFGTEAVDGYTVQFERGHLGLVKAPST

SEQ ID NO: 96 - protein, 534 aa, Hypholoma sublateritium
MSTPAIPSHTTVLVIGGGPGGAYSSTVLARDGVEVTLFEAAQFPRYHIGESMLPSINAFYAFVGAQDKLRAAGFCPKPGAAVKLQQGKKEAYTNFIERNEHDASYNVVRSELDEILLRHSQEAGTAVFEQTRVTDIVFDEKAPESDPRPIGANYVRNGTTGYISFDYLVDASGSKGLMSTKYLKNRKMNQTLHNIACWGYWSGQGMYMPGTYRHNAPWFEALSDESGWAWFIPLHNGTVSVGFVMDKAISIQKKADLREKDPEAFSLKAHYLDQMQYTPGLRELLKNATMKDGDLEGSGPVKSTSDFSYSASNYAGDHYRLVGDAACFIDPFFSSGCHLAHLGGLSAAMTICASLRKHCTEAQASHWHDTKVATSYTRFLIVVLSAYKQIRSQVNNILSDVDEDNYDRAFDFFRPVIQGTADVGKKLTEDELQKTIEYCTNIFLPGDPELRESVGERIGVEMLSNTQPIMSMDEMEKITGGEEDAMMALKQVNARKPLVGLYGALDSMKSENIGGLVAVLTRGQMGLSVAEPAT

SEQ ID NO: 97 - protein, 613 aa, Termitomyces sp.
MSSLKHPPQVPFSDRRPPSADPFQHTQVLVIGGGPAGSYAASALAREGLDVTLCEAATFPRYHVGESLIPSARQYLRFIGAESALVDHGFVFKPGSAIKFNQFKREGYTDFLALGCENNAWNVVRSEFDQLLMNHARASGAAVYERTKVTDVSFSSTDPTKPVSVTWSHTPTPSVSPSTAPWAPLTSFLGKIMSPLTVLKSPVITGTTTFNYLIDATGRAGLLSTKYLKNRHYNASLKNLAVWGYWKGTTLYGAGTARQGSPWFEALTDESGWAWFIPLHDGTISIGIVVNHKIFDRALKQPLPPSPFSHPSTFNPTNSKIIAYYLSALALAPGVVELITSGGSMVEGSVKSASDFSYSAASYAGSNYRIVGDAGAFIDPFFSSGIHLAFTSALSASATICASIRGHCPELSAAEWHSRRVSTSYTRFQIVVLSAYKQIRAQKMDILCDIDEDNYDRAFAFLRPVIQGASDMGVRLSETELQKSLDFCVSLFNPTSPEQHERLSRSSGLCNEVFDINAPLVDPAIFRDALQIGFQSLDSCSEIDSDSDTDGDQSFSESDRVLETKLILEKINARRVIHSEYHLNNMEVESIGGYVMRLEKGTLGLARTTHKAR

SEQ ID NO: 98 - protein, 458 aa, Flavobacteriales bacterium
MATKIQNIIVLGAGTAGWLTALFVRKLFPHYNIKIIGNKKIGIIGVGEATTPPFVDFLREIDIDPLAMVRETGGSIKQGISFEDWNGDGKKYFHGFYEKFLSDVSIPPIFSHDCGDYYYKHLIHKKLDFNEYSYATKLSYQNKTDLDGIAYAIHFDTNRLSTYLGKIAKERNIEYVEGEYSKMKLKYDFIFDCSGLSRLIIKDKSKWKSYRKYLPMKHAIPFHLPVKENKPYTSAIAMKYGWMWQIPLQDRIGAGYVFDSDYIDAAQAQEETEKFLGHKIDVRKVINFEAGRHEKYWVDNCMAVGLAACFIEPLESTSIHLTVLQLQLLRQFASDLFDGTNDMFNEVITNTMDEILYFIYLHYITKRKDSSFWRNFKKDYPCPPAFKPVLQAIQNNNLKHYDIKSTNRIQPGFSVTSYLQIANGLGLFKKDINIKEYTNLTPTVKEIKKFIDQKTQSI

SEQ ID NO: 99 - protein, 600 aa, Metarhizium anisopliae
MAVPPSCTVLVIGGGPAGSYAAAALAREGIETVVLEADKFPRYHIGESTLPSLRHFFKFIDFYDTVDAYGFYHKVPSSLHFFHLNEELTSPYQAKNGAVFRLAQAQPDACKSPSPAYTDFLEAGGPNGYAWNLIRSEFDDLLFKHAGTCGAQIFSETRVDTIQFEPVANGLKPDMNRNLGDNLNPGRPVSATWVRKDGTSGSITYKYLVDASGRQGILSTKYLKNRKFNNNFKNAAIWAYWKSDNVYGPGTHMEGSPYFEALDDASGWAWFMPLHDGTRSVGIVQDQKMATEKKHELGRPSTLDFYKQCLQMAPGIRELLSEAELIPHVRAACDWSYTASTYHLPNARICGDAGSFIDPLFSSGVHLAITGGLSAAATISASIRGDCSEAAAGSWHSKKTVESYTRFFLAVSSATKQIRTQHEPIIKDMDEDGFQRAFDLFRPIIQGTADADEAGKVSQLEISKILHFCFKAFTYVPPEKKDALFDKLRKLDSKALQDDAKQVQTLDGIEKHLTADELQILEILRSRRMIREDPFEMDSFTLDTIDGMAPRLVRGTLGLVNYEQAKIDKAHFYSQDFLDGNYPGIREGSVHLPTSRVQLG

SEQ ID NO: 100 - protein, 398 aa, Deltaproteobacteria bacterium
MKICIIGGGTSGWWCAAYMQKFLDAEITLIESKEIPTSGVGESSLPQIGAFFEELGIPEEEWMNGCNAVHKYGNMKYEWDGVGKDPFLMTFWQDDPKGRFDKWYQEYKSGVKDKNSHTELYNRDGWRSVAYHLDANLANSVVKDYCKDVNHIIDTLDELPEGYDLYVDASGFARKFTTDKTEVIWDHHLVNSAWVCPFQLEGEINPYTQTIARECGWQFIIDLQNRTGSGYVYSDKYISDVQALEHFKGWTEGRKNYNNIVPRLIKWRPNVLKNSWKDNVVTIGLGQGFVDPLEANGLYMVVYSITLLVKCILKGSKPEAYNKAMLKVQKQNSDYLLHHYMLSDRKDTPFWEYYSKFDMDESLWKNYKKYPNKYNNLYPDALWAQLGIYFEKFKHYTP

SEQ ID NO: 101 - protein, 564 aa, Ophiocordyceps unilateralis
MAVPKSCTVLIIGAGPAGSYAACCLAREGIDTVVLEADKFPRYHIGESTLPSLRHFFKFIDVDDAFDAYGFFKKGSSRNGAVFRLNQAHPDALTDFIEAGGPDGYAWNLIRAESDDLLFRHAKACGAHTFDETKVDSIQFERGTDRTCFGEGQDKAMDSGRPVSATWSRKDGSAGTIAFKYLIDASGRHGILSTKYLKSRRFNRGFKNVASWAYWKSDNLYGQGTSWEGLPYFEALQDASGWCWYMPLHDGTRSVGIVQDQAMATDKKRKLGKPSTSEFYRQSLELATRTNELLSGATLASDIKSASDWSYTSSTYHIPYARICGDAGCFIDPLFSSGVHLAIAGGLSAAVTIAASLKGDYDEETAGSWHSKKTVESYARFLLAVCAATKQIRYEDEPVMHDFDEEGLQRAFDILQPIIQGTVDGEARGRTTDIEVSQVLKFCFRAFNYVPHEKKEALFEKLDRLDPGFGEGDAAKRIEEMHKHLTAEEMEIVEALRSRRLIREDVFTLGSFTLDIIDGLAPRLVRGELGLVKASKARLDSRHFLSAPFLDGKVEAIRTHGEGI

SEQ ID NO: 102 - protein, 516 aa, Amycolatopsis coloradensis
MVIVGGGTAGWLSAAYLNRAFGGKVDITLIESPRIPRIGVGEATVPTLRTTFAFLGMKEEDWMPKTNAVFKSAVRFNDWRKPHEGRDSHTYYHPFFDVPEPAVQNYEKPFHKRFGRGVSLAHFWLKQRLAGDTRVRETFGDAGMALQRLCELNKAPKPLPGTDAPDPGYRYAYHFDAALIAKYLRELATGRGVKFVSADVTSVTVDPRGTIEKVVTDTAGEIEADLFLDCTGFRGLLINKTLNEPFVSANDVLLCDSAVALPARHREGGLRPYTSATAKPDGWIWEIPLADRDGTGFVYSSAFTTPDKAERRLREHLGGRGYDIDGNHIKMRVGHNRRSWVNNCIAVGLSSCFVEPLESTTIALIEYQLALLVLHFPDSDFDERRKARYNELMVGAFEDLRDFIVMHYTLTDRDDTEFWNAVREAPIPASLEEKLTEYAESVIIPDGSQLRLFETRSIWAILSGMDFGFKKAPPSVEKMNDAAAWEMFEKIDKEREIYSAGLPGHREYIEALHRGF

SEQ ID NO: 103 - protein, 507 aa, Aphanizomenon flos-aquae
MTKNIVVVGGGSAGWLTALTAKKKYPKLNVTVIESKDIGILGAGEGSTPYLPLFLETLDISIEDLVKNCDATIKNGIKFSNWNNDNDFYYHGFGFIDPSLGTEALSSKFLSASPMLVSSIALNNDLKDLDFTENVSEKNKVPFVLEKNKSGKTVSEYKKIGKTSFHFNATKLAERFKDIGLERGIEVFENTITKVSLDENNNVVGLDLDSGITIPSDFVFDCSGFHRLIIGKTFNSKWKSYKEFLPVDSAIPFFLDMTEKIPPYTEAIAMKYGWVWKIPLQNRFGCGYVYDSSLISQEEAIKEVEEFLGFTPYYPRKDKGGFSFSPGSFEEPWQNNCVAIGLAANFVEPLEATSLWVSMVALTEIFSSPDFLTNNSDEIRSEFNKLILNMNDDILNFIYLHYMSLRKDTEFWKKFSYEMAPDELKQKLKVWEKRMPGKRDNGNFWNSASWFVVASAQEKINKGLAQEYVDMSDEYKKAVDSYEYYKKYREYKVTECTDHRQFLEGLK

SEQ ID NO: 104 - protein, 526 aa, Rhodobacteraceae bacterium
MTFWPRMATGCRNGRACHSARQAKTMWPRRICVVGGGTAGWLAAMMLGDSARRGGHPCEVTVIESSKIGTIGVGEGTTAVFRQMLQHFGLDEMEFLAETGATIKFGIRHRDWRRLGHSYDGPIDDPHRVTGFEVNALDLYQVSRGESVGQVHLFQHLLSRNKSPFAVVDGRHIAVGPFHHAYHFDQALAGKWLRSKAKAIATIDDQVLRVERLAESGDITALHLEGGARVEADLFVDCTGFRRALIGPMGGTWVSYRDMLPVNRAIPFWLDIPKGEEIDPCTLAWAQGSGWMWKIPTQSRYGCGYVFSDAHITPDQAKDEIERVLGRPIHVRNDIRIDAGRLDRQWIGNCVALGLSSSFLEPLEATSIHGTVVQLMLLASVLPNPDDRARLAFNAASARQVDDFRDFIRLHYVSERRDTPFWRDVAGNLPPHLADRLAAWGGRVPGAADFAPFPMGLPHTDHHLHVPVLDGLGLLDPAKAKDWLAAHPKLRAQARAEAAKLTGEYKRAAGRAMGHRAFLDGLGVTA

SEQ ID NO: 105 - protein, 507 aa, Gammaproteobacteria bacterium; identical to SEQ ID NO: 21

SEQ ID NO: 106 - protein, 549 aa, Asticcacaulis sp.
MIISRLNGKNGKPPIMTKIASEPASPPHRDVLIVGGGAAGWMTAAYLAKHLGTDRNGGPRITVMESPDIGIIGVGEGTFPTIRNILRTLGIDEAGFMRESHATFKQGIRFDDWEVTPKDGRRSHYFHPFEQPYWSREELNLLPYWLLQDKDKRLPFAEAVTFQKKVADSKLAPKRIHQGNYQGPLNYAYHFDAHRFAGVLAKYAKDLGVHHLSGNLDGVTLDADGAIAHITAKEHGDLKADLYIDCTGFRSEILGKAMGVPFKSIKDTLFTDRAVAIQVPYEKPDSPLESYTISTAHEAGWTWDIALSTRRGIGYVYSSDHTDDDRAEEVLRAYVGPMAEGVEARCIRFNAGYRTQHWVKNCIGVGLSAGFLEPLESTGMVLIESAVNKIVEFFPFRGPLDASAHIFNEAMTKRYETIIGFIKLHYCLTKREEPFWRDNTRPDSIPPHLRELIALWKFRPPSRFDFTLDNESFAFFSYQYILYGMNFETDYEAARGSLQHTDLANHLFARISQFGDQASKDLVSHRQLINAVYKGGFVERPNAPMAVAR

SEQ ID NO: 107 - protein, 498 aa, Asticcacaulis sp.; identical to SEQ ID NO: 22

SEQ ID NO: 108 - protein, 559 aa, Dyella thiooxydans; identical to SEQ ID NO: 54

SEQ ID NO: 109 - protein, 511 aa, Unknown; identical to SEQ ID NO: 11
  Description of Unknown: Euryarchaeota archaeon

SEQ ID NO: 110 - protein, 497 aa, Albimonas pacifica; identical to SEQ ID NO: 57

SEQ ID NO: 111 - protein, 492 aa, Pseudoalteromonas byunsanensis; identical to SEQ ID NO: 20

SEQ ID NO: 112 - protein, 537 aa, Unknown; identical to SEQ ID NO: 15
  Description of Unknown: Euryarchaeota archaeon

SEQ ID NO: 113 - protein, 495 aa, Nostoc minutum
MNFHIKKVAIVGGSSAGLLSAVTLKYFFPKLHILLLYSKKHAPIGVGESTTAWFPQFLHEHLNISREEFYKSIWPVWKLGIRFEWGVPHISHFNYTFDGQFRYESQLLSKIPGFYCMHDMRQASRYSILMDKHHAPLLHDGKGNIKILSDGFGYHIDVYEFINYLTAKALSLGVDIQDLEVLDAKLDEYGNVQHLCCADDLKVNADLFIDCSGFKSQLLGKALQEKFISFGYRLFCDSAIVGNWKRRSPIFPFTTATTMNSGWRWRIDLRDRVSFGYVYSSSFCSQDEAIQEYLSLTPYATEDLRKISFRSGRYKRFWVNNVIAIGNASGFVEPLESTGQHMIVETIWRVVLALQDSNLCPTPKLIDATNRYVVDLWDEICDFLTLHFKFNRRLDTPFWKYCQEETDLGSLQNLVELYQDSGVCHAIAHLIPKSSIFEIDGYLTLLCGQQVLVKNLQPMADAEITEWLKYRQILHNNLENSVSPQEAFYFLESLY

SEQ ID NO: 114 - protein, 503 aa, Cylindrospermum stagnale; identical to SEQ ID NO: 58

SEQ ID NO: 115 - protein, 489 aa, Nonlabens sp.
MKIYIIGGGSSGWMTATTMLTKFPDADITVVESPSKPPVGVGESTTQYFRIWADYVGLKDEDWMVACDATYKISVRFSNFHDVDDTPWQYPFGSPNYNLAHPDVWFWNQYKRGWSNDKFARDYWIAAECAEHNLLPIKDPNFKIKKNTGFHFDAVKFAEWLRDNKCQSVKRIIGTVDDFERVGDDIKYLWIDEKQHEADLYFDCTGFTSLLNNSEWLDYSDWLPNDTAWVTRLEYKDKQEELKSYTQCTALSSGWVWTVPTFARIGTGYVFSSKYQDHQSALKEFASFLKYDTEEFRKIHFKTGRKKEIWCGNVVSIGLSGGFIEPLESNGLLSVHEFLLKFCRMWKPRTTQMMRDTYNKAVAFAFDGFASFVALHYALTQRQDSDYWKAVSQIRYPDGNMIEAAKITMLEESHNFGTKLNWQNADGDSLYCVMAGHGWNPFTDVIESEILFHGGIPEDSHLNSWTHQWNHARLGVNPLDYYNRTLYAV

SEQ ID NO: 116 - protein, 582 aa, Actinosynnema sp.; identical to SEQ ID NO: 59

SEQ ID NO: 117 - protein, 500 aa, Nostoc calcicola; identical to SEQ ID NO: 67

SEQ ID NO: 118 - protein, 528 aa, Nostoc sp.
  'Peltigera membr. cyanobiont' 232
MIPKFHEACILEYRTILIDSFIHVEKTIHNVVVLGGGGGSAGFLSALALKVKMPWLNVVVVHSTNIPVIGVGEATTAWIPWFLHKYLELNREQFYEETQPIWKLGIKFIWGDSTQSHFNYPFVTHLADKLSVLSKSTAYYCLDSTTESSIYSLLMEQNKSPCFQRENGDFVVDERFGYHIENTSFVAYLERRAAELDIKIIDKAVVNIEVAENGYVRQLKFTDETTLAGDLFVDCSGFRSTLLGETLQEPFCSFSSSLFCDSAVTGRWMRDDAIQPFTTAQTMQSGWCWQIDLQDKVNRGYVYSSGFISDDDALQEMKCQNPLMGDEHNLIRFKSGRHQRFWVKNVVAVGNASGFVEPLESTGLHMIGETIKCVCDVLIDSDQQPSPGLINLANLANRAIAQKWDDIRDFLSIHFKFNRRVESKFWRHCWHKTDIGDAETVVDFFQNNGPSPIGQILLRKNSVFGYNGYLNLLMGQQVPTKYQSDNDTLDLDNWRQVKNHFIKNCANALPIQEAIQVVKERKCQWLTS

SEQ ID NO: 119 - protein, 716 aa, Cellulophaga sp.; identical to SEQ ID NO: 62

SEQ ID NO: 120 - protein, 486 aa, Flavobacteriales bacterium
MKKVNKLVIVGGGTAGWITASWFSRRWGSKIDVTIIDKYQPERVGVGEATLLSFPSVMQKMGFRVEDWVKRIDATFKAGILFPGWGREDKVIWHPFGFTSIGDNKVPMYDIWSNYQSKYDVKEISPLYRTAMGNKIELDYIKDTYAYQIDCGKLVTFLHDNCNKICNYIQSDVKTVVKVDDDVEKIILEDGSEIKADLFIDCTGWNQLLIGKEDNVDLSDRLFIDSALAARVKYENPDKEMHPYTDCQAMEHGWRWRIPTRSRIGTGYCFNKNITSPDEVAKQFSEHWNGRIKPEDMRLLDWKPQMIDKFWKGNVVSIGLSAGFIEPLESTGLAMMIRGCEYLEESLYGCIYNPVFEPDIYNIRMKASFETAVDYVNMHYSYSERKGKFWDYVRLSHEKSGMQILMENQILDPNNETLQTDKISSFFGGTNWHIWLLQLMPEITKKTYWYPDTVDILSRFEKYIQTLDNNVKEATPQKILLKEWYG

SEQ ID NO: 121 - protein, 479 aa, Flavobacteriales bacterium
MKVKDIVIVGGGSSGWMAAAAISRCNDVKVTLVDKEVPTPLGVGEATLLSFEKFMVEQCGFNPNEFLGELDAGLKAGILFKDWGHKGNEIWLPFYWLNYPFTDPPVSMVDAWSTSQDIDFKKLEVLYQCSMDNIIDRTQIGEGYAVHIDCIKLIKYIKEKISDRITYVNSSVKAYLGGNTLYLENGDKIEADLFVDCTGFKSILKRKRDRVNLSDRLYVDTAVAGPIEYEDKHNEFRPYTTTTAVYDGWIWNTPLQSRIGTGLVFNRNITPIDQAKEYFCSFWDQRTTPDKLKVIDWTPYYDTNQWEGKVVSIGLSAGFIEPLESTGLGLIIEGIKTLSKLLNDGFCNEYDVNYYNNHMTLAYEQCVDYVNCHYSKSNIKSPFWDYVRDNYKMSEAQEVFLDEMSSENKTIMPGGKGFIFGVGNWIHWLIQAGYPLEPRSWMKHDKMDESLNHLIECEDKKIELGTDLMGHNEFADKFL

SEQ ID NO: 122 - protein, 347 aa, Chromatiales bacterium
MVPYGYHLDAAMLARFLKRKATEAGVEHIEDTVTDVTVSDGNITAVTGVKASYSADVFIDSTGFRSLLISKLKADNWQSFSDALPCNKAVAIQRALPQGHSPNPYTVATALSNGWVWQIDLTSRQGTGYVYDGNRLSKEQAEQELRDYLGWHSDVIKCIHLDMNVGCRKEFWVGNCIAVGLAGGFIEPLESTGLHLINLGARLLGTHLMQPHPTQAVKDAYNKAMNGFYQDLKQFIVLHYCLSNRTDTEFWREAPAKAQLCEGLPEKLELWKHKICEYHDLAGGYATTFVDENYRYILYGMQHYPALQYHSAETDKEVFARLQQLSDKAVEMTLPHVEFLQKIAAVR

SEQ ID NO: 123 - protein, 523 aa, Pseudogymnoascus sp.
MTVPTKCTVLVVGGGPAGSFAAAALARESYEVVLLEADKFPRYHIGESMLPSMRYFLKIIDFYGKFNEHGFTRKNGAAFQFNRSQPEAYTDFIAADENGYAWNVVRSEADDMLFRHAGACGAHIFDETKVMAIQFAEVNGLAAINGSNGHAEKKIGKPVSATWTRKDGTSGTVSFDYLIDASGRQGLLCTKYLKNRTINPNLKNIADWGYWTGGAKFAPGTRMEGAPYFEALEDGTGWGWYIPLHNGTVLAKKKQMASPSSKDFYISWLGLAPEIKKLLVHATLDGNIKSASDWSYHASTYAIPGARICGDAGCFIDPLFSSGVHLAVLGGLSAAVTIAAVKRGEVSEERAMSWHSKKVTESYMRFFLVVSTGVKQIRSQDAPIIRDNDEVGFDRAFDIFKPVIQGRADADSTGTLSTEDIHKTIEYCFNALMHISPNNALIDKLKSVYDLGGNDEIKAKAITDLKKTPTVEESQELKYILGFVEDMFTIDNFTLNSIDGLVPRTERGMLDLEVAHNAAYHRY

SEQ ID NO: 124 - protein, 537 aa, Unknown
  Description of Unknown: SAR202 cluster bacterium Ae2-Chloro-G2
MQKVSDVDILVIGGGPAGSTAASMAAKYGLSVKICEKSKFPREHVGESLLPASIPILEELGLGEKIKKAGFLPKYGATMVWGRDKTPWSWRFSETNKQNTHSYQVSRPIFDEILLRRSEELGVSVEEEATIDKVNLEESNRGAFVTSLNKGQYFQPANFIIDASGQSALIARSLKIREWDESFHNLAVYGYFSGATKLETPDENNIFIESYQNGWVWSIPLADGTTSVGVVVDSKNASTQLQKTDPTAYLLSELSLSPKTSDMLLNSNLTTNAKVVKDWSYTTSKMAGNGWALAGDAACFIDPLFSSGVHLAMMSGVLSSAYAVTYLKDRILGEESASVYETTFRQEYDHFRDLALLFYSSNRTVDSYFWEARRLFKEENYFSDRTSFIRAVSGQSVRGYERVALERGELPNEFMSAINLHNEESEKRNAHLLKIQNSIQMQVPTLSNEVKLEKKPVLSEGEFQWGTVITTPFRKEGVPCSNLVANLLMKIDGKKSLIDIVDDLSRSASESAKEKLLKYSIDTISILYVEGVIDNLS

SEQ ID NO: 125 - protein, 575 aa, Talaromyces marneffei
MAIPEKTTVLVIGGGPAGSYCASALAREGIETVLLEAEKFPRYHVGESMLPSLRHYLRFIEADKKLDAHGFIRKNGALFKLNSKPAAYTDFVGAGGPNGFSFNIIRSQADDLLFRHAGTSGAKIFDGVKVNSIEFVPSGLPRSDDPDCEIPDPGRPVSASWVNKDTGDAGSIKFDYLVDASGRQGLVSTKYWKNRKMNTGAQLQSVATWGYWTGGGIVEKGTSREGCPYFEAIADASGWTWYIPLHNGQWSVGVVMNQKVLADKKRAAGDGKNVYLQTIRETPGLQALLENGELVTELRSASDWSYNATAYSSPYLRVAGDAGCFIDPFFSSGVHLALTGGFSAATTICASIKGQTSEIGAAIWHTKKVSESYTRFLVIVSTALKQINEKDEPVISDFDEKTFERAFKHFRPIIQGTVDVQGKLSQAEVSQALNFCFRAFHQVDSKEKQNLIEKMRSLAISDPDDLSNEKYSAALKELEAVLTPDQLHILQTIRARQMLRPEDMFTVETIGSDVIDGLSVNMVTGQLGLVHPGKAFKVAPSNKDILALLNGEELSESSIGFKTDPGYQNPTAAAH

SEQ ID NO: 126 - protein, 513 aa, Aspergillus luchuensis
MTHAYCKYSECTVLVVGGGPGGSYAASVLAREGIDTVLLEADVFPRYHIGESMLPSLRHFLEFNGALPEFEAHGFNMKKGAAFKFNSKPPGYTDFLKAGGHHNYTWNVLRSEADSILFHYAGECSCKTFDGVKVTSLEFRATEPSVNGNVGFPESASWTRRDKSTGSIQFEYLVDASGRAGLMSTKYLKNRRYNEGLKNTAIWGYFKNAATYGVGTSMKGSPYFSLLEDASGWTWAIPLHNRTTSVGVVQHQNSVKAKKQAMGSPSSKDYFLSCLHEVSGIMDFIEGAELVSEVGSASDWSYNASSYAATNVRIIGDAGCFIDPLFSSGVHLALLGALSAAATICASMKGQCSEQAAGEWHSEKVREACTRFLLVVSSAYAQMVHKDRPVLNELGENSFDRAFDIFRPIIQGTVDANGKIAEKEVQESIEFCVRVLQKIDHEQSGVDTESARAGHIFQQDELENMKHIIMNSNETFTLDSFGADIIDGMTANIKRGSLGLEIVGDTCSHDNFL

SEQ ID NO: 127 - protein, 582 aa, Ophiocordyceps sp.
MSIPDTCTVLVVGGGPAGSFAAAALAREGIDVVALEMEKFPRYHIGESMLPSMRHFLQVIDFYDDFNARGFTKKVVSPISLLVKKTSSACQRILAYQLTTCLPSRTARHSVSIRLNPMPVQLDFLAAGGPDSHAWNVIRSEADEMLFKHAIASGARAFDDTKVDAIHFTNGVGGSEESKLGRPTSAAWTRGDGSSGTISFEYLVDASGRNGILCKRYYKNRKVNDNLKNMAIWGYWKGSDTYGSPGTRSENMPYFETLQDASGWCWHIPLHDGTHSVGIVLNQDLATKKKHELGSPQTKDFYLKSLQLVPRTSQLLSQAELVSDIKSASDWSYCASAYAFPYVRIIGDAGCFIDPYFSSGVHLAVMGGLSAAVTISASIRRDCDEETAASWHSKKITESYNRFFMVVSYMAKIMFSKNEPEIEGTYNEGVQNAFDILQPVLQGTTDANTSGNISLVEMFKMFKFILVALTGSSTEQVDDLVAKLEAPGFDAETDPAVTEIVKSFQESLSIEESHVFDLLQNMRWYLQDYYTIDSFTLNPIDGLVTCMERGKLGLVSADKKKAGKSLACRVESSARQACDEVN

SEQ ID NO: 128 - protein, 443 aa, Bacteroidetes bacterium
MNKFYDAIIIGGGPAGSTMASKLAEKGQHVLVLEKAKFPREHVGESLLPFLYHLFEELGVLDEMKARFSRKPGVTFSNIDGTEASHWCFKHVIKDESGLSFHVRRAEFDDMLLQNSRKKGAEVMEEVSVQKVDLDIDPNQATVYAENAQGEQLQFTGRMVVDASGQNTILATQMKTKKPFESLTPRVAYSSHWENAKLTPELAAGNIKIVHLEGEKMGWFWMIPLIDRLSVGVALNMSYANQQRRILKETTTDWQAKLYEQELQESLVAQEVLAGATRMGPVMANGDFSYYSSTKWGTNFVIVGDASGFLDPIFSSGIYLGMKSSLLVAEGITDMLGGNGTATIETAYSDIQGAYKLVEKLINTFYEPGSIKWDQAGSAFDLSYKKFETAYSILHLILAGDFFKNHAKYFKAIDILRTPQKIEQYKHLIGHDEPTMEQRVCIA

SEQ ID NO: 129 - protein, 475 aa, Sorangium cellulosum
MQGHSVLLLEKEKFPRHQIGESLLPATTYGICGLLGIRDRIERAGFTRKQGGTFRWGKSPEPWTFRFAENPRVPGGYAFQVERSVFDKMLLDAAREKGVDVREEHAVVRVEQEDGRFSRVRFRDDRGSERTATAKYIVDSEGHRGQTYALVGERVFSQFFQNVALYGYFLDGKRLPAPSSGNILCAAFRDGWFWYIPLSDRLTSVGAVVSREAAQRIQDGPEQAFQSFVDSCPIIAEYLASATRVTEGVYGEFRVRKDYSYCNTRFWKPGLVLIGDAACFIDPVFSSGVHLATYSALLAARSINSCLAGDIDEEEAFEEFEFRYRREFGNFYQFLLSFYDMHQEADSYFWKARKVLNTDEKANDAFIRLVAGASSVDEPAFNHAEDFFRSRQGMGQWLEGMLSNQLAMQVDGLPGQSAPATLEGGPDAEQFMEGFTAEVRQIQTQAMFGHRRARESSVRPQGLIPSTDGFAWQRG

SEQ ID NO: 130 - protein, 367 aa, Acidobacteria bacterium
MKMKTDVLIIGGGPGGATAAMLLIREGIKPIVLEQETFPRFHIGESMTGEAAQLLRRLGLEEKMLSANYPVKHGVKVYGADGVNAWFIPVCARTPDWKLTPGTTWQVRRSHFDGMMLDEAAKRGANVIRGKAVKPLLGEDGSMRGVTMRRPDGSHEDIEAEVTLDCSGLATFLANQRVTGPKYVGNYDKQIAFFSHATGAVRGSASSGEDAKDNTLIFYLKKFHWAWFIPIDDEVVSLGLVVPTATFQESRQTPEEFFRSTLPGINPALARKVSDIQLVEKVHVIPNYSYQVRRFCGKGFICIGDAHRFIDPIFSFGISATLREAEFAVPHVLAYLGGKGRDLANPFAEHMLFCEKGTDNLEDMVDL

SEQ ID NO: 131 - protein, 459 aa, Verrucomicrobia bacterium
MKMKTDVLIIGGGPGGATAAMLLIREGIKPIVLEQETFPRFHIGESMTGEAAQLLRRLGLEEKMLSANYPVKHGVKVYGADGVNAWFIPVCARTPDWKLTPGTTWQVRRSHFDGMMLDEAAKRGANVIRGKAVKPLLGEDGSMRGVTMRRPDGSHEDIEAEVTLDCSGLATFLANQRVTGPKYVGNYDKQIAFFSHATGAVRGSASSGEDAKDNTLIFYLKKFHWAWFIPIDDEVVSLGLVVPTATFQESRQTPEEFFRSTLPGINPALARKVSDIQLVEKVHVIPNYSYQVRRFCGKGFICIGDAHRFIDPIFSFGISATLREAEFAVPHVLAYLGGKGRDLANPFAEHMLFCEKGTDNLEDMVDLFWEQPFAFATFVHHRYREQMIDAFAGRVYPSEQQPSPAILAFRKMLKRTRDYEHEDDYSIPIGSRFHPERAAIWEPNSPLPATEEWMFAHSS

SEQ ID NO: 132 - protein, 492 aa, Penicillium nordicum
MSIPTKATALVIGGGPGGSYAASALAREGVDTVLLEADVFPRYHIGESLVASIRPLLKFIDLDDTFVNYGFVRKNGAAFKLNNQKEAYTDFILDPGAGTYAWNVIRSECDELMFKHAAKSGAKTFDGAKVTSIEFIPDETNVESPGRPVSASWKTKDGRTGIIDFQYLVDASGRAGITSTKYLKNRTFNSYLKNVASWGYWRGATPYGVGTPVEGQPYFEALQDGSGWVWFIPLHNGTTSVGVVMNQEMATKKKKVSSVTSSQAFYLESLEGARGISRLLEPSTLEGDIKQASDWSYNASSYGSSHLRIVGDAGAFIDPYFSSGVHLALSSGLSAATSICASLRGDCEEEAAWKWHSQGVANRYGRFLLVVLGATKQIRARDTPVMNKDGDEGFDDAFTVIRPVIQGIADVPGRTTHREILDAVAFSTNVVGPDIEGTEQAWVEKDHGALSCEEEEVGRVMNNLAKAYKAQDVYEGLTARLERGALGLQVAN

SEQ ID NO: 133 - protein, 548 aa, Unknown
  Description of Unknown: SAR202 cluster bacterium
MSQTASPYDVVVIGGGPGGSTAATMLARQGLRALLLERDHFPREHVGESLLPASIPVLEELGALPAIQQAGFLQKWGATMVWGKDPEPWSWYFKETNPKYPHSYQVSRPEFDHILLDNSRQAGVEVREGYRATRVTFEGGRAVGVRCESSTKEPLEIAAGFVVDASGQGGLLARQLGLRQWDPFFRNLAVYGYFQGAQRLPEPDETNIFIESYPQGWLWTIPLHTGLASVGAVVDSETGQEGIRRLGPRGFLMDQLSQGPATAEMLRKAELSSGPDVVRDWSYVCKKTAGPGYVLVGDAACFVDPLFSSGVHLALMSGVLAAALVTSSLSDPDIEEAAGQVYQELYIQEYNQFRELARLFYSSNLSSDSYFWEARRLTGKDAAFTPRQAFIRTVAGQPPRGYERAVLEHGDAPSEFISSVGQVETDRARRQADLSAFLDPSGAMHHMFYSAVPSLAPGVTVVRKPVLGEGRFDWGNVIVTPSQPEGTPCSALVAEVASAIDGRTPVRGLMAKLQEDRDPSSAPIIEQTVVSAVQILYVDETISELISQ

SEQ ID NO: 134 - protein, 552 aa, Trichophyton soudanense; identical to SEQ ID NO: 64

SEQ ID NO: 135 - protein, 1069 aa, Trichophyton violaceum; identical to SEQ ID NO: 60

SEQ ID NO: 136 - protein, 531 aa, Agaricus bisporus
  var. bisporus
MPNAQLPSRTTVLVIGGGPAGAYAASALARENIDTIVIEAAKFPRYHIGESMLPSLNSFMRFIGAEEKLRDHGFTTKLGAAVKFNQHKKEGYTDFTRGDVRNASCNVIRSEFDNMLLRHAEESGARVFEETKITDIEFETNGAEMRPTSATYTRKNGEVGVVHFDYLVDASGRNGIVSTKYLKNRKMNQSLHNLACWGYWTGQKQYMPNSSRHNAPWFESLTDESGWAWFIPLHNGTVSVGIVMDSSISAQKKAEGRKATSDGNYTLRDHYLDQIQLVPGLKAFLEEATLKEDGEHYVIRSAADYSYAADKYAGDHYRIIGDASAFIDPFFSSGVHLALLGGLTAAASIAASIKKQCAEEVAWKFHDVKVATAYTRFLLVVMSAYKQIRNQSVAVLSDVDEDNFDRVFDIFRPVIQGNSDVGKNLSENELERTIDFCKDIFAPTDPEMIEAVGARLRPELLAANSPILTNEEINIESQGDDEARIVLHRLNARKPVNQMYQGPDNLQVGDVGGYVAHIQVGALGLVEVAST

SEQ ID NO: 137 - protein, 530 aa, Coprinopsis cinerea; identical to SEQ ID NO: 36

SEQ ID NO: 138 - protein, 502 aa, Melittangium boletus
MLNIPASTKVLVLGGGPAGSTAASFLARAGVEVTLIEREMFPRYHIGESLLPSCLEIADLIGARQKIEAKGFVKKPGAYLEWGREKWSLDFGELQGQHTYSFQVDRSEFDELLLRHSEEQGVRVFEGVEVKSIENNAEGRPVKAVWAVHGDESQTGEISFDYLIDASGRHGVMSTRYLRNRQFHKVFQNIAVWGYWEGTQKGADYRDGAIAVGSIPDGWIWAIPMSGGKTSVGVVVHKDSFQAQKREADTAKIYEDAIASCPLIQRVCSGAKLVTGLKTESDYSYAAESFCGPGYFLCGDAACFLDPLLSTGVHLAMLSAMLSAAAITSVVSGEVSEQEAQSFFEKSYRQAYLRFLVFVSVFYDQRCGKDNYFKEAERLSQYEKDPSRLKQAFLNLVSGLEDLSSAEQATSHLIGEMSRRVTENLTLRKDKSTLASGSEEIKGRAQDNARFFDGVEGIPVMTPEGAIDGLYVVLKPRFGLGRFVATVEASSIVNVKKEEVRL

SEQ ID NO: 139 - protein, 528 aa, Halobellus rufus; identical to SEQ ID NO: 50

SEQ ID NO: 140 - protein, 421 aa, Chromohalobacter japonicus
MHTEASLQAADCDVAIIGAGPAGAAAAARLSRLGWRVHVIERSHFPRFSIGESLLPQSMAYLEAAGLLETVQAGGYQPKNGAAFTRHARTTTIDFREKSTPGWGTTYQVPRADFDQRLIHAAEAQGATLEFGTTVTAFNADAARPVLQLEDEQGTTRHLSARFVLDASGYGRVLARLEALERDPRAEPRMAIFSHVEDGIEDADYDREKILIGVHPEDAGIWYWLIPFADGRASVGVVGDIETLTAHGDSPEARWQALLDQEPRFRQLLHQARRVREVNEIRGYAASVTRLHGPGYALLGNAGEFLDPVFSSGVTIALHSAHLAAPLIDRQLHGEKIDWHADFETPLRAGVDTFRAFVEAWYAGTLQTIVFHEAPPPRFKRWISGVLAGYAWDRDNPFVTASRRRLATLAEVCAQRDEVRS

SEQ ID NO: 141 - protein, 413 aa, Photobacterium leiognathi
MLNNRQRTQVAIIGAGPSGAVAAALLNQHKVDVVVLEKNTFPRFSIGESLLPACMEVIKKANMVDAVNAADFQYKNGAAFRRRDTYTAFDFRDKFTDGAGTTFQVQRGNFDKVLADEAAKQGVEIRYQHNVEAVDCGDSTSVLTVRDEVSDQVYQLEADFILDASGFGRVLPRLLDLEQPSCLPVRHAIFTHVVDHIEDSGVEHDREKILISVHPTNEDVWFWLIPFSNGTCSLGVVAEPAFLAQYDADEKTALQQIVAEEPTLNKLLSKAEYSNPAAQIGGYSANVKNLATNNYALLGNAGEFLDPVFSSGVTIAMQSADFAVNALLKQLAGDEVNWQQDYADKLMVGVNTFRTYVEGWYSGELQKVIFYTDPEPKIKQMVCSILAGYAWDQNNPFVAQSERRLRTLAEICS

SEQ ID NO: 142 - protein, 427 aa, Halomonas titanicae
MATGAAKQMKTHDTTDVAIIGAGPSGAAAAAWLARRGINVRVIERQRFPRFSIGESLLPQCMVHLEACGLLDAVQTGDFQFKNGAAFTWRDRYAAIDFRDKFSPGPGTTWQVERADFDQRLIDGARQAGASVEFETQVEAFVADHDRPSLTLVDANGEQRSLQARFVLDASGYGRVLARLTGLARPSTLESRCALFTHIEDRIDCSHYDRDKILIGLHPEHSGIWYWLIPFSQGRASVGVVGDRATLEAAGVDDKERLWHFLHAEPRLNKLLVNAKAIRDIGRLEGYSADVEQLHGPGFALLGNAGEFLDPVFSSGVTIALDSALRAAPLVERQLAGEKIDWDSQFEQPLRRGIATFREFVDAWYDGRLPRIIFNDQQIPRIREMISSVLAGYAWDEENPFVAASRRRLHSLAEACSDISSHATGEG

SEQ ID NO: 143 - protein, 585 aa, Myxococcus xanthus
MSGAWEGKLYDVIVMGGGPAGATLAARLRKDPGLSVAIFESERFPREHIGESFVPSAVSSLQESGALGRVLSSDCWIKKGGGYYSWDAVRPWSTFFEHKAYERDGYRRWAFHANRAELDDILLRHAEENGAEVFEGTPVKQVYRRDGFTEVDLGEKGSARCKVFVNASGRYSVTSLGGPREFLSSYRNIAIWSYIRKGKPAQSLPGDWNIFRESGVSPIGSFAFEDGWFWYIPIPLEVDGRREVVHSLGLVTDPRGLKSKRDYMSPSVFMETARKVPFLCDLVADAELIYDEFRTTANYSRISHQMCSWENREIRVGDAAFFVDPLFSTGVHFALHHTAAAAVLVRAAFDEAMPEQHREDLWHDYDQMLRKQAQVFSLAIDQWYNEISLAHPGSVYWRERSERATFEVRNATFHYLVNGSLDEDLLHVISQGNDAVEALSETGAWRTSFAQLQRLRPADDALVQLMPNVKFRQSVTLEHPIADSAEDKLDARPQAFDHGPYWESPERHAHEVAPRFGRPSPCLRFYFEDGDHQDTVRILWNRPNSALLERLSQPHAYGPLLAGCSLSERGLLDQLLLKGMMRVIP

SEQ ID NO: 144 - protein, 406 aa, Pseudoalteromonas phenolica
MDQFKSYDVVIIGSGPAGSLCGIECRKKGLSVLCIEKDEFPRFHIGESLTGNAGQIIRDLGLADEMNAAGFPDKPGVNVIGSLSKNEFFIPILAPTWQVRRSDFDNMLKRRALEHGVEYQQGLVKDVIKHEEKVVGAIYKADGVEHQVRSKVLVDASGQNTFLSRKGIAGKREIEFFSQQIASFAHYKNVERDLPPFSTNTTILYSKQYHWSWIIPISPDTDSLGIVIPKDLYYKECKNPDDAIEWGMEHISPEIRRRFKNAERVGESQSMADFSYRIEPFVGDGWLCIGDAHRFLDPIFSYGVSFAMKEGIKAADAIKRAIDGNDWKTPFYEYRDWSNGGQQIAADLIRYFWIYPIFFGYQMQNPDLRDEVIRLLGGCCFDCEGWKAPTIFRNAIEEYDRKQMAG

SEQ ID NO: 145 - protein, 449 aa, Acinetobacter baumannii
MGDYDFDVGIIGGGPAGSTMASYLAKAGISCAVFEKELFEREHVGESLVPATTPVLLDIGVMDKIEKANFPRKFGAAWTSADSGPEDKMGFQGLDHDFRAAEILFNERQQEGVDRDFTFHVDRGKFDRILLEHAGSLGAKVFQGVEVADVDFVKPGDVRLNVKLGNQKVGIRTRMVVDASGRHVLLGRRLGLREKDPVFNQFAIHAWFDNFDRRSATRNPDKVDYIFIHFLPLTNTWVWQIPITETITSIGVVTQKQNYTKSGLSYDDFFWEAVKTRENLYDALKASEQVRPFKKEADYSYGMKEVCGDSFVLVGDAARFVDPIFSSGVSVALNSARIASKDIIAAVRNNDFGKASFAEYEGMIRNGIKNWYEFITLYYRLNILFTAFVQDPRYRLDVLQLLQGDVYSGERLKVLDKMHEIVATVESDPDHLWHKYLGDMQVPTAEPAF

SEQ ID NO: 146 - protein, 567 aa, Serratia sp.
MTQNSPANGRDSNHFDVIILGSGMSGTQMGAILAKQQFRVLIIEESSHPRFTIGESSIPETSLMNRIIADRYGIPELDHITSFYSTQRYVSSSTGIKRNFGFVFHKPGQEHNPKEFTQCVIPELPWGPESHYYRQDVDAYLLQAAIKYGCTVRQKTKVTEYHADKDGVAVSTAEDERFTGRYMIDCGGPRAPLATKFNLREEPCRFKTHSRSLYTHMLGVKPFDDIFKVKGQRWRWHEGTLHHMFEGGWLWVIPFNNHPKSTNNLVSVGLQLDPRVYPKTDISAQQEFDEFLARFPSIGAQFRDAVPVRDWVKTDRLQFSSSTCIGDRYCLMLHANGFIDPLFSRGLENTAVTIHALAARLIKALRDDDFSPDRFEYIERLQQKLLDHNDDFVSCCYTAFTDFRLWDAFHRLWAVGTILGQFRLVQAHARFRASRDEGDLDNLDNDPPYLGYLCADMEGYYQLFNDAKAEIEAVSAGLKPTGEAAARIHALIDERDFAKQMFGFGYCITGDKPQLNNSKYSLLPAMKLMHWTQTSAPAEVKKYFDYNPMFALLKAYITTRISLSRKK

SEQ ID NO: 147 - protein, 556 aa, Saccharopolyspora erythraea
MNTQRHSNDKTPYDVAILGTGIGGSMLGAILARHGAKVLLIDAGQHPRFAIGESTIPYTLLTLRILADRYDVPEIKALATFTDTSRTIGNTFGVKKHFGFLLHHENEPQDPREVSQFNTPGLLHEAAHLHRQDTDAYLFHVAIRYGCTARQNCRVAEVEFDDSGVTLETVNGEQFRTRYVVDASGFRSPLAEKFGLREDPCRFKHHSRSLWNHMLDVTPTDKVLDRPREHRPPVPWYEGTVHHMFERGWFWVIAFDNNKLSSNPLCSVGLTLDERRYPKPTDISPEEDFYRHAARFPDVARQYEGAKPAREWVSTPRLQYSSSHTVGDRWCLLAHAAGFIDPLFSRGLSNTAEAVNSLSWRLIRAVKDDDFSAERFEYVDRLQQRLLDHNDELVNAAFISWCDYDLWTAVFRAWASGTNAGSYRLSKAITEFAKDGRDEHFMALEEPPHLGLYWPDHDGFAKFFESMVSQCDLVEQDMLSPRQAADNIYTQLREADFVPKHFGFAERGQRFINPTPMRFIKTVRWAMREGDPKLRGLIINNAKEALKARVKGQKLY

SEQ ID NO: 148 - protein, 437 aa, Enhygromyxa salina
MTSSTQDVIIIGGGPGGSALGSYLSKAGISNTIFESAIHPRPHVGESLVTSTTRIFQDIGFLETMEREGFVRKYGASWHPIKRNAELTIEFAEFPQEGIEQDYTYHVDRARFDALLLKHASELGSTVYQGTEVKQVLMEGDRACGVRVAVAGQTIDVPAKLVVDASGRRAVLGRQLKLLEKDPQFDQFATHAWFENVARSATGRLHDIHIYFLPVERGWVWQIPITETITSVGVVVEKRDFVQNKGEIEAWFHEMLCSTPDGAVAMQDAVRINEFKREGDYSYRMSRFTGPGYLMIGDAARFVDPIFSSGVSVATYSAKFASEAIHRVLRGGEDEATAFDDYATTLGAGCSIWYEFICLYYRLLPLFTLFIQNDDYRMQILRLLQGEVFQREEVTVLDAMRRFISAVEANDEHLMRPYLGDVDLSVVDELRVPTRAP

SEQ ID NO: 149 - protein, 487 aa, Verrucomicrobia bacterium
MNSITIVGGGTAGLITALILKKRLDVKIQAIVPSNIGIIGVGEGSTEHFDDFRQHLHLDVKDVLRETKGTLKSGIMFEDWTNKHSRYLHHIHSMWNIKLGLSARNYEYLMINNKGASCFAPMTLFHNEVGLEPSDRLVQYHFNTFKLNEYLIKLCKENNINIIDDEIVDVNLNDKGIKELKGKKKTYKSSFYIDCTGFKKLLISKLGAKWQSYSKYLKTNSAIAFPTGDQEDYNIWTLAKAMKYGWMWQIPTYGRTGNGYVYSDQYTNKEEAKKEIEKLLGKEIEIAKHIKYDPGALDKPWIKNCVAVGLCANFVEPLEATSIGTTIQQAFLLMQYLENYNQQSINIYNKQVSTVMENVRDFIQLHYINDKKTTNFWKDVNKVEPSDTLKQYMHVWKSGRLLKSTDMESIGHYNLFTLFKEDNFNLIAYFNGLIDTKLLRNSYNIVNKNLKRYWLENRIEGDMLWRNTDRTRKMSHKKYIQEIHDKN

SEQ ID NO: 150 - protein, 975 aa, Trichoderma virens
MANIPEQCTVLVIGGGPAGSYAASALAREGIEVVLLEAEKFPRYHIGESMLPSMRHFLKFIDAYEKWDAHGFNIKKGGAFRLNWSRPETYTDFIAAGGPGGYAWNVVRSEADELLFKHAAECGVQTFDETKVASIEFAPATSDVQSLGRPVSATWTRKDGSSGTVSFDYVVDASGRAGLISTKYLKNRSYNQGLKNVASWGYWKNGGVHGVGTHKEGAPYFEALKDGSGWVWFIPLHNGHHSVGVVQNQEMAAKKKREMTEPSSKGFYIESLDLVPGIKELLANAELVSEIKSASDWSYSASKYAFPGVRIAGDAGSFIDPFFSSGVHLALSGGLSAATTIAAAIRGDCGEKAASSWHDKKTAESYTRFLLVVSSALKQIRSQDEPVINDFDEATFERAFDLFRPIIQGQADADAKGKLTQAEISKTVEFCFKAFAHVSFEEKEALVKKLKELGLDGDAYDESNRKALDELEKKLTPEEQSILKTLKGRRMVRPEDSLNIDNFTLDSIDGLAPRLERGKLGLATAKKAEVKFTRHDPLSFLNGESKAVKKALQNGHAELNERSEVHSTNVTNGDKPLNGHTKVEDQSVASLVAELVASERSLPQASLDESSRHRLISSLQESAEELETPYDSMLRFLNASRQIALIKIGGDLGIFKCLAESKTPLSSKELAKPNMADPTLVGRIMRYLVANRLAAETAPDQYVARKMTYALADPQIEGPMRFFHAVSSPSFQALPDFLKETGYQNQPQTSALQKGLNTDLGLFAWLKQHPDLLKDFQNLMGIPKEGNCLDVISFESAVIGGHEGPVFVDIGGNTGHQAKQLLAKYPELANRVVVQDREETIKSASDVKGFQLMAHDFFSPQPVQGAKYYYLRAILHNWDDDKASQILSNIVPSMSTDSLMLIDELVIADQGSHVWPAGLDLQMYTLFGSSERTASQWDSILDRAGLRPVAVKKYAPVMGSSVIFAAPKFRCYTTL

SEQ ID NO: 151 - protein, 644 aa, Trichoderma virens
MAATAPVPKHTFAERAAANNLSDSQILNSNNVAGSSLPKESDVVIAGGGIHGLIYAIHSAKHKPGNLKILLVEKNRKPGYKIGESTLPVFSMWCKMYGLTAEYLLRIFGLKDGLCFYFLDRENQGKFKDFVINGTAGTLLSGFQIERPTSELLFTLLAQRSGVNVYHGTEVNFDGTTVDGGLNKCNIGIAKGKSNDTPETSIQSSILVDATGRFRRVASKNAPIHRFEGWNYDAFWGYFTNPKDTSKMPFPHYESCNTNHICFPEGWIWVIRLLSWEGSPTANLMDMMTYLLDCAESGVPADQIPSTDELAKMFGLNYRWITSLGFAVRNDVEYPEDMSAYGTREAERRFNYFVEKYPLIKEFMSNFELIEDHYGPGTTWYIRKSLTYQSPVVSGPGWISIGDACGFTNPLWSPGINVGLSTSTYAAELTHKAFDAAKNANPEAAELSIRETMAPYDAYAKRLIPALNQMNCFNYVCFRDPRLGAQISAAWQNIASALQGWGRIQGNYTLTPETFVDYATNWCYGAINPAYDIVARKAIELLAPIPLKDAVPDHIVQEVIEFADSIKKSTLESGCINLRWGGLFRRFDNRLNYLEEKETKDTFARPCSNCSSWFVLRPDWKKCYSCGTERTDEESTILWNPVLV

SEQ ID NO: 152 - protein, 531 aa, Pleurotus ostreatus
MASIAVPSASTILVIGGGPGGSYSAAVLAREGLDVVLLEADKFPRYHVGESQLASLRHFLRFIDLEKEFEEFGFQRKDGAGFKLNRHKREGYTDFVSQDPNNFSWNTVRSQADELMLRHASKCGAKVFEETKVTELEFEGSEQSGRPVAALWKQKSGATGRITFSYLVDASGRNGIMSTRYLKNRQFNSLLKNVACWGYWEGTGKYLPGTSRENSPLFEALADESGWAWFIPLHDGTTSVGIVMNQDISNEKKAKAKESGEDTSLVAHYLSELKRAPNVLALIGDGVHIKKSDAPLISAASDYSYSATSYAGPHYRIVGDAGAFIDPYFSSGVHLAISGGLSAAATICAEMKGGCTSTEAIAWHSAKVDTSYTRFMLVVLSAYHQIKSQEAPVLSNKDEDNFDRAFDFFRPSKYRTDWTFIQGNTDVGRKLQGDDLRRTVEFCAKHAYEPSLPEERKELVEKFGDPLRVLSAESAEDSEQVATEKRILKGVAIRKLMRTEDIVHIDNFVADNLLGYKLRLIRGSLGLEKVL

SEQ ID NO: 153 - protein, 524 aa, Pleurotus ostreatus
MSLPRIPQRTTVLVIGGGPAGSYASTLLAREGLDVVLLEALKHPREHVGESMLPSMRQYLRFIDLENEYDIRGFLHKPGAFFKFIHGAPACYADFDILGRDKNTWHVFRAEADELMLRHAAQQGVKVFEEVRVDSIEFAGSDPTTSRPIAANWKSKLGETGALSFDWLIDASGRQGLMATKYLKNRIYREGLRNVAAYGYWEHAAAPVEEGNPRQNATWIECLTDKRGWAWHIPLHNGKTSIGVVMHQETSNQKKAVGPKGLEAHYLDQVKLAPGVLERLGHGASYITGSVRSTADFSYHAKSYSGDHYRIIGDAAAFVDPLFSSGVHIGMTGALSAACTILGSMKEQITEVGACAWHDAKIGISQIRFLLVVLSAYRQMQHQGNYTVLGDFNPQDFGRAFELFRPVYQGQHDVENKLTNEELERMIDFTRNFFLPISQDQHAAVSERLGHFMPINGPVMGPDDLAKVLDDDDSDAKAVLQKINARKVLSTEMGSSGLNSESVNGYTLILEKGRLGMKKEIGVA

SEQ ID NO: 154 - protein, 521 aa, Pleurotus ostreatus
MSLPRIPQRTTVLVIGGGPAGSYASTLLAREGLDVVLLEALKHPREHVGESMLPSMRQYLRFIDLENEYDIRGFIHKPGAFFKFIHGAPECYSDFDLLGQDKRTWHVFRAEADELMLRHAAQQGVRVFEEVRVDSIEFAGSDSMSSRPITANWKSKLGETGAISFDWLIDASGRQGLMATKYLKNRIYREGLRNVAAYGYWENAPVEEDGSHQNATWIECLTDKRGWAWFIPLHNGKTSVGIVMHQETSNQKKADGPKGLEAHYLDQVKLAPGVLKRLGNDATYITGSVRSTADFSYHAKSYSGDHYRIIGDAAAFVDPLFSSGVHIGMTGALSAACTILGSMKEQVTEVEACAWHDAKIGVSQTRFLLVVLSAYRQMQHQGNYTALGDFNPQDFGRAFELFRPVYQGQHDVENQLTNEELERMIDFTRNFFLPVSQDQYADVGERFGQFTEINGPVMGPDDLAKVLDDDDSDAKAVLQRINALKVLSNEMGSSGLNSEAVNGYTLVVEKGRLGMKKVINA

SEQ ID NO: 155 - protein, 10 aa, Artificial Sequence
  Dsg200; Dsg600
VLVVGGGPAG

SEQ ID NO: 156 - protein, 10 aa, Artificial Sequence
  Rdc2
ILVAGGGPAG

SEQ ID NO: 157 - protein, 10 aa, Artificial Sequence
  Dsg700
VLIIGGGPAG

SEQ ID NO: 158 - protein, 10 aa, Artificial Sequence
  CmdE
ILVVGGGPAG

SEQ ID NO: 159 - protein, 10 aa, Artificial Sequence
  CndH
LIVIGGGPGG

SEQ ID NO: 160 - protein, 10 aa, Artificial Sequence
  VhaA
VVVAGGGPGG

SEQ ID NO: 161 - protein, 10 aa, Artificial Sequence
  Clohal
VIVIGGGPGG

SEQ ID NO: 162 - protein, 10 aa, Artificial Sequence
  PltA
VVIIGGGPAG

SEQ ID NO: 163 - protein, 10 aa, Artificial Sequence
  HrmQ
IGIIGGGPAG

SEQ ID NO: 164 - protein, 10 aa, Artificial Sequence
  CmlS
VAIIGGGPAG

SEQ ID NO: 165 - protein, 10 aa, Artificial Sequence
  Bmp2
VVIIGSGPAG

SEQ ID NO: 166 - protein, 10 aa, Artificial Sequence
  PrnC
VIILGSGMSG

SEQ ID NO: 167 - protein, 10 aa, Artificial Sequence
  HalB
VAILGSGIAG

SEQ ID NO: 168 - protein, 10 aa, Artificial Sequence
  Thal; Thdh
VVILGGGTAG

SEQ ID NO: 169 - protein, 10 aa, Artificial Sequence
  RebH
ILIVGGGTAG

SEQ ID NO: 170 - protein, 10 aa, Artificial Sequence
  KtzQ
ILVLGGGTAG

SEQ ID NO: 171 - protein, 10 aa, Artificial Sequence
  PrnA
IVIVGGGTAG

SEQ ID NO: 172 - protein, 10 aa, Artificial Sequence
  SttH; PyrH
VVIVGGGTAG

SEQ ID NO: 173 - protein, 10 aa, Artificial Sequence
  KrmI
ICVVGGGTAG

SEQ ID NO: 174 - protein, 10 aa, Artificial Sequence
  MibH
VGVIGGGTAG

SEQ ID NO: 175 - protein, 10 aa, Artificial Sequence
  Dsg400
VAIVGGGSSG

SEQ ID NO: 176 - protein, 10 aa, Artificial Sequence
  Dsg500
VTVIGKGTAG

SEQ ID NO: 177 - protein, 10 aa, Artificial Sequence
  Consensus
  SITE (4)..(4): Any naturally occurring amino acid
VVIXGGGPAG

SEQ ID NO: 178 - protein, 8 aa, Artificial Sequence
  Dsg200
GWAWLIPL

SEQ ID NO: 179 - protein, 8 aa, Artificial Sequence
  Dsg600
GWCWFIPL

SEQ ID NO: 180 - protein, 8 aa, Artificial Sequence
  Rdc2
GWCWTIPL

SEQ ID NO: 181 - protein, 8 aa, Artificial Sequence
  Dsg700
GWAWFIPL

SEQ ID NO: 182 - protein, 8 aa, Artificial Sequence
  CmdE
GWIWGIPL

SEQ ID NO: 183 - protein, 8 aa, Artificial Sequence
  CndH
GWFWYIPL

SEQ ID NO: 184 - protein, 8 aa, Artificial Sequence
  Clohal
GWWWCIPL

SEQ ID NO: 185 - protein, 8 aa, Artificial Sequence
  Dsg800
GWLWYAPL

SEQ ID NO: 186 - protein, 8 aa, Artificial Sequence
  PltA; HrmQ
TWVWQIPI

SEQ ID NO: 187 - protein, 8 aa, Artificial Sequence
  CmlS
GWVWMIPI

SEQ ID NO: 188 - protein, 7 aa, Artificial Sequence
  Bmp2
WSWIIPI

SEQ ID NO: 189 - protein, 10 aa, Artificial Sequence
  PrnC
GWLWVIPFNN

SEQ ID NO: 190 - protein, 10 aa, Artificial Sequence
  HalB
GWFWVIGFDN

SEQ ID NO: 191 - protein, 10 aa, Artificial Sequence
  ChlA
YWIWMIPIER

SEQ ID NO: 192 - protein, 9 aa, Artificial Sequence
  Thal, Thdh; RebH; PrnA
GWTWKIPML

SEQ ID NO: 193 - protein, 9 aa, Artificial Sequence
  KtzQ
GWSWKIPLL

SEQ ID NO: 194 - protein, 9 aa, Artificial Sequence
  KtzR
GWIWTIPLF

SEQ ID NO: 195 - protein, 9 aa, Artificial Sequence
  SttH
GWIWTIPLI

SEQ ID NO: 196 - protein, 9 aa, Artificial Sequence
  PyrH
GWMWTIPLF

SEQ ID NO: 197 - protein, 9 aa, Artificial Sequence
  KrmI
GWCWNIPMR

SEQ ID NO: 198 - protein, 9 aa, Artificial Sequence
  MibH
GWCWTIPTP

SEQ ID NO: 199 - protein, 9 aa, Artificial Sequence
  Dsg400
GWVWNIPLW

SEQ ID NO: 200 - protein, 9 aa, Artificial Sequence
  Dsg500
GWCWTIPLQ

SEQ ID NO: 201 - protein, 10 aa, Artificial Sequence
  Bmp5
SWLTSRIVNK

SEQ ID NO: 202 - protein, 10 aa, Artificial Sequence
  FMO
GYPWDMLLVT

SEQ ID NO: 203 - protein, 10 aa, Artificial Sequence
  DiMeAnilMon
GYPWDMMYVT

SEQ ID NO: 204 - protein, 10 aa, Artificial Sequence
  MICAL
RWAEGAESLE

SEQ ID NO: 205 - protein, 7 aa, Artificial Sequence
  Cyclohex
YSVPVGN

SEQ ID NO: 206 - protein, 7 aa, Artificial Sequence
  BaeyerVill
FAVPARN

SEQ ID NO: 207 - protein, 8 aa, Artificial Sequence
  Digeran
GYSWIFPK

SEQ ID NO: 208 - protein, 7 aa, Artificial Sequence
  Antiport
YGWIFPM

SEQ ID NO: 209 - protein, 9 aa, Artificial Sequence
  PHBH
FGWLGLLAD

SEQ ID NO: 210 - protein, 9 aa, Artificial Sequence
  MethOxPhen
WRVSAPRPK

SEQ ID NO: 211 - protein, 9 aa, Artificial Sequence
  KMO_HS
WPRNTFMMI

SEQ ID NO: 212 - protein, 9 aa, Artificial Sequence
  KMO_Pf
WPHGDYMCI

SEQ ID NO: 213 - protein, 7 aa, Artificial Sequence
  W2Mono
GWDSDFP

SEQ ID NO: 214 - protein, 10 aa, Artificial Sequence
  StyA
GELIEIPTLS

SEQ ID NO: 215 - protein, 8 aa, Artificial Sequence
  Consensus
GWCWTIPL

SEQ ID NO: 216 - protein, 18 aa, Artificial Sequence
  Dsg200
IAGDAGCFIDPYFSSGVH

SEQ ID NO: 217 - protein, 18 aa, Artificial Sequence
  Dsg600
IIGDAGCFIDPFFSSGVH

SEQ ID NO: 218 - protein, 18 aa, Artificial Sequence
  Rdc2
IVGDAGCFIDPFFSSGHH

SEQ ID NO: 219 - protein, 18 aa, Artificial Sequence
  Dsg700
IVGDAGAFIDPFFSSGIH

SEQ ID NO: 220 - protein, 18 aa, Artificial Sequence
  CmdE
LVGDSGAFIDPLLSSGVH

SEQ ID NO: 221 - protein, 18 aa, Artificial Sequence
  CndH; VhaA
LVGDAACFVDPVFSSGVH

SEQ ID NO: 222 - protein, 18 aa, Artificial Sequence
  Clohal
AIGDAACFIDPLFSTGVH

SEQ ID NO: 223 - protein, 18 aa, Artificial Sequence
  PltA; HrmQ
LIGDAARFVDPIFSSGVS

SEQ ID NO: 224 - protein, 18 aa, Artificial Sequence
  Bmp2
CIGDAHRFLDPIFSYGVS

SEQ ID NO: 225 - protein, 18 aa, Artificial Sequence
  PrnC
LMLHANGFIDPLFSRGLE

SEQ ID NO: 226 - protein, 18 aa, Artificial Sequence
  Bmp5_
LLSHAAGFVDPLFSRGLS

SEQ ID NO: 227 - protein, 17 aa, Artificial Sequence
  Thal; Thdh
SVGLASCFVEPLSSGIY

SEQ ID NO: 228 - protein, 17 aa, Artificial Sequence
  RebH
SIGTSSCFVEPLSTGIY

SEQ ID NO: 229 - protein, 17 aa, Artificial Sequence
  KtzQ
AIGVSAMFVEPLSTGLY

SEQ ID NO: 230 - protein, 17 aa, Artificial Sequence
  PrnA
SIGLSSCFLEPLSTGIY

SEQ ID NO: 231 - protein, 17 aa, Artificial Sequence
  SttH
AIGLSSGFVEPLSTGIF

SEQ ID NO: 232 - protein, 17 aa, Artificial Sequence
  PyrH
AVGLSAAFVEPLSTGIF

SEQ ID NO: 233 - protein, 17 aa, Artificial Sequence
  KrmI
AIGNSYAFVEPLSTGVH

SEQ ID NO: 234 - protein, 17 aa, Artificial Sequence
  MibH
AVGNSYAFVEPLSSGLL

SEQ ID NO: 235 - protein, 17 aa, Artificial Sequence
  Dsg400
GIGLSYGFIEPLSTGLL

SEQ ID NO: 236 - protein, 17 aa, Artificial Sequence
  Dsg500
SVGLNAAFVEPLSTGLW

SEQ ID NO: 237 - protein, 18 aa, Artificial Sequence
  Consensus
LIGDAACFVDPLFSSGVH

The invention claimed is:

1. A method of identifying or detecting amino acid sequences which encode or provide halogenases, said method comprising:

(i) probing or screening a candidate amino acid sequence for the presence of:

```
                          (SEQ ID NO: 1)
Fx•Px•Sx•G,
```

wherein "x" is any amino acid and each "•" represents independently the number of x residues ("x's") between each conserved residue, and (ii) subjecting an amino acid sequence identified in step (i) to comprise SEQ ID NO: 1 to an assay to determine the level or presence of halogenase activity.

2. The method of claim 1, wherein the halogenase exhibits a broad substrate specificity.

3. The method of claim 1, wherein the amino acid sequence probed for the presence of the motif provided by SEQ ID NO: 1 is a sequence selected from the group consisting of:

(i) a deposited sequence;

(ii) an uncurated deposited sequence;

(iii) a hypothetical protein sequence;

(iv) an unannotated sequence;

(v) a prokaryotic sequence;

(vi) a eukaryotic sequence;

(vii) a sequence from a microorganism;

(viii) a bacterial sequence;

(ix) a viral sequence;

(x) a fungal sequence;

(xi) a plant sequence; and, (xii) a mammalian sequence.

4. The method of claim 1, wherein step (i) of the method is an in silico method.

5. The method of claim 1, wherein step (i) of the method further comprises screening or probing the amino acid sequence for a motif having the sequence

```
                          (SEQ ID NO: 3)
GxGxxG
or
                          (SEQ ID NO: 4)
WxWxIP.
```

* * * * *